United States Patent 11,098,302 (IDENTIFICATION OF POLYNUCLEOTIDES ASSOCIATED WITH A SAMPLE) - sequence listing, part 145

SEQ ID NO: 547237 - DNA, 514 bp, Homo sapiens
  misc_feature: HIJSMM301AOPVE.17.31.C09.1.454.light.4.raw
cgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagccccg

SEQ ID NO: 547238 - DNA, 485 bp, Homo sapiens
  misc_feature: HIJSMM301DOTLE.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaacggaccgaaggtaggaagtacaaacgaactagtggctgcacca

SEQ ID NO: 547239 - DNA, 489 bp, Homo sapiens; identical to SEQ ID NO: 535139
  misc_feature: HIJSMM301BIIV1.14.55.E11.1.454.light.4.raw

SEQ ID NO: 547240 - DNA, 492 bp, Homo sapiens
  misc_feature: HIJSMM301EUTK2.10.79.H02.1.454.light.4.raw
catagtagtgcacgaccggtgctcgatttagtgtcacacgaagggaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgagatttgcagtgtattattgtcagcaatatggtaggtcacctgggacttttggtccaggggaccgaagctggagatcaaacgaactgtggctgcaccatctgtctt

SEQ ID NO: 547241 - DNA, 503 bp, Homo sapiens; identical to SEQ ID NO: 540136
  misc_feature: HIJSMM301DQYN2.19.10.A10.1.454.light.4.raw

SEQ ID NO: 547242 - DNA, 487 bp, Homo sapiens; identical to SEQ ID NO: 536206
  misc_feature: HIJSMM301E1UKA.47.38.D05.1.454.light.4.raw

SEQ ID NO: 547243 - DNA, 495 bp, Homo sapiens
  misc_feature: HIJSMM301CH811.9.1.A01.1.454.light.4.raw
tgatacgtctcacgaccggtgctcgatttagacgtctcatcagggggaggctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 547244 - DNA, 507 bp, Homo sapiens; identical to SEQ ID NO: 538702
  misc_feature: HIJSMM301CYDQI.11.57.F02.1.454.light.4.raw

SEQ ID NO: 547245 - DNA, 502 bp, Homo sapiens; identical to SEQ ID NO: 539314
  misc_feature: HIJSMM301A3VNA.21.81.H04.1.454.light.4.raw

SEQ ID NO: 547246 - DNA, 493 bp, Homo sapiens; identical to SEQ ID NO: 536461
  misc_feature: HIJSMM301AZ1PA.10.20.B09.1.454.light.4.raw

SEQ ID NO: 547247 - DNA, 496 bp, Homo sapiens
  misc_feature: HIJSMM301C5UK5.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccaggggaccaagctggagatcaaacgaactgtggctgcaccatctgtctt

SEQ ID NO: 547248 - DNA, 507 bp, Homo sapiens
  misc_feature: HIJSMM301ESTYW.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaactagtggcgtgcaccatctgtcttctatcttcccgt

SEQ ID NO: 547249 - DNA, 490 bp, Homo sapiens; identical to SEQ ID NO: 535234
  misc_feature: HIJSMM301AD4IW.17.21.B10.1.454.light.4.raw

SEQ ID NO: 547250 - DNA, 489 bp, Homo sapiens; identical to SEQ ID NO: 535139
  misc_feature: HIJSMM301ED789.14.55.E11.1.454.light.4.raw

SEQ ID NO: 547251 - DNA, 511 bp, Homo sapiens
  misc_feature: HIJSMM301AFEC1.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggaggaccaagctgaccgtcctgggtcagcccaaggctgccccctggtcactctgttcccaccct

SEQ ID NO: 547252 - DNA, 493 bp, Homo sapiens; identical to SEQ ID NO: 536969
  misc_feature: HIJSMM301DTDDE.27.78.H01.1.454.light.4.raw

SEQ ID NO: 547253 - DNA, 494 bp, Homo sapiens
  misc_feature: HIJSMM301CUSCL.22.86.H09.1.454.light.4.raw
  modified_base (480)..(480): a, c, t, g, unknown or other
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggaggaccaagctgaccgtcctaggtcagcccaaggctgccccctggtcactcngttcccacctcctc

SEQ ID NO: 547254 - DNA, 477 bp, Homo sapiens
  misc_feature: HIJSMM301C8EE0.40.10.A10.1.454.light.4.raw
tctagcgactcacgaccggtgctcgatttagcgtcgatctcaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtggatgtcaaccgaactgtggctgcacca

SEQ ID NO: 547255 - DNA, 507 bp, Homo sapiens
  misc_feature: HIJSMM301CRE3M.15.59.F04.1.454.light.4.raw
tctacgtagccacgaccggtgctcgatttagtacacacacttagggattggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcattttcggcttcggcggagggaccaagctgaccgtcctaggtcagcccaaggctgccccctcggt

SEQ ID NO: 547256 - DNA, 490 bp, Homo sapiens
  misc_feature: HIJSMM301B2BM5.40.33.C11.1.454.light.4.raw
tctagcgactcacgaccggtgctcgatttagagtgagctcgttgggtttgggtcaccgcagcctgagaatccactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcctaggtcagcccaaggctgccccctcggtcactctgttcccaccctcctcagtcgctaga

SEQ ID NO: 547257 - DNA, 480 bp, Homo sapiens; identical to SEQ ID NO: 540601
  misc_feature: HIJSMM301ECF3D.40.21.B10.1.454.light.4.raw

SEQ ID NO: 547258 - DNA, 496 bp, Homo sapiens; identical to SEQ ID NO: 537925
  misc_feature: HIJSMM301A87FN.22.14.B03.1.454.light.4.raw

SEQ ID NO: 547259 - DNA, 496 bp, Homo sapiens; identical to SEQ ID NO: 538625
  misc_feature: HIJSMM301B5GG1.2.49.E05.1.454.light.4.raw

SEQ ID NO: 547260 - DNA, 494 bp, Homo sapiens; identical to SEQ ID NO: 534992
  misc_feature: HIJSMM301DGGKC.9.1.A01.1.454.light.4.raw

SEQ ID NO: 547261 - DNA, 493 bp, Homo sapiens
  misc_feature: HIJSMM301B0SW5.13.11.A11.1.454.light.4.raw
tcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcat

SEQ ID NO: 547262 - DNA, 478 bp, Homo sapiens
  misc_feature: HIJSMM301BR8FN.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaagtaggagtgtcaaccgaactgtggctgcacca

SEQ ID NO: 547263 - DNA, 521 bp, Homo sapiens; identical to SEQ ID NO: 538715
  misc_feature: HIJSMM301CAJ9A.27.23.C01.1.454.light.4.raw

SEQ ID NO: 547264 - DNA, 495 bp, Homo sapiens; identical to SEQ ID NO: 535486
  misc_feature: HIJSMM301DEZOS.26.72.G06.1.454.light.4.raw

SEQ ID NO: 547265 - DNA, 486 bp, Homo sapiens; identical to SEQ ID NO: 535385
  misc_feature: HIJSMM301ANHUM.19.71.G05.1.454.light.4.raw

SEQ ID NO: 547266 - DNA, 383 bp, Homo sapiens; identical to SEQ ID NO: 447524
  misc_feature: HIJSMM301BVGZH.41.26.C04.1.454.light.4.raw

SEQ ID NO: 547267 - DNA, 492 bp, Homo sapiens
  misc_feature: HIJSMM301A8X2N.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaacgaactgtggctgcacatct

SEQ ID NO: 547268 - DNA, 477 bp, Homo sapiens
  misc_feature: HIJSMM301DA5BI.4.74.G08.1.454.light.4.raw
  modified_base (470)..(470): a, c, t, g, unknown or other
  modified_base (475)..(475): a, c, t, g, unknown or other
agcactgtagcacgaccggtgctcgatttagtagctctatcagggggcaggagtcagacccactcaggacacagcatggacatgagggtccccgctcagctcctggggctcctgctgctctggctcccaggtgccagatggtgccgatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctggacgtgtcacggacgaacgtaggaagtacaacaacaagtgngtcgnca

SEQ ID NO: 547269 - DNA, 499 bp, Homo sapiens
  misc_feature: HIJSMM301DCB48.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcggccaagggaccaaggtggaaatcaaacgaactgtggctgcaccatctgt

SEQ ID NO: 547270 - DNA, 493 bp, Homo sapiens
  misc_feature: HIJSMM301CE3C6.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggttcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtctt

SEQ ID NO: 547271 - DNA, 493 bp, Homo sapiens; identical to SEQ ID NO: 537281
  misc_feature: HIJSMM301EFR6X.9.1.A01.1.454.light.4.raw

SEQ ID NO: 547272 - DNA, 463 bp, Homo sapiens; identical to SEQ ID NO: 535008
  misc_feature: HIJSMM301E2DTT.10.9.A09.1.454.light.4.raw

SEQ ID NO: 547273 - DNA, 505 bp, Homo sapiens; identical to SEQ ID NO: 539391
  misc_feature: HIJSMM301DUFM0.43.22.B11.1.454.light.4.raw

SEQ ID NO: 547274 - DNA, 494 bp, Homo sapiens; identical to SEQ ID NO: 535478
  misc_feature: HIJSMM301AH3O8.10.79.H02.1.454.light.4.raw

SEQ ID NO: 547275 - DNA, 492 bp, Homo sapiens
  misc_feature: HIJSMM301EV0DD.43.53.E09.1.454.light.4.raw
tgtgagtagtcacgaccggtgctcgatttagagagagtgtgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 547276 - DNA, 499 bp, Homo sapiens
  misc_feature: HIJSMM301B3T0T.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggtagggaccgagggtggacgatacaaacgaacgtgtggctgcgaccatctgtcttcatt

SEQ ID NO: 547277 - DNA, 519 bp, Homo sapiens; identical to SEQ ID NO: 544217
  misc_feature: HIJSMM301BZH7E.27.23.C01.1.454.light.4.raw

SEQ ID NO: 547278 - DNA, 508 bp, Homo sapiens
  misc_feature: HIJSMM301C4JBD.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtggatatcaaacgaactagtggctgcaccatctgtctt

SEQ ID NO: 547279 - DNA, 497 bp, Homo sapiens; identical to SEQ ID NO: 538296
  misc_feature: HIJSMM301BTWCF.18.11.A11.1.454.light.4.raw

SEQ ID NO: 547280 - DNA, 486 bp, Homo sapiens; identical to SEQ ID NO: 544510
  misc_feature: HIJSMM301BTSMR.19.71.G05.1.454.light.4.raw

SEQ ID NO: 547281 - DNA, 454 bp, Homo sapiens; identical to SEQ ID NO: 534964
  misc_feature: HIJSMM301AMXG8.19.86.H09.1.454.light.4.raw

SEQ ID NO: 547282 - DNA, 489 bp, Homo sapiens; identical to SEQ ID NO: 536013
  misc_feature: HIJSMM301EIQ3Z.26.23.C01.1.454.light.4.raw

SEQ ID NO: 547283 - DNA, 440 bp, Homo sapiens
  misc_feature: HIJSMM301ANGEN.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccccctcctcatagtataga

SEQ ID NO: 547284 - DNA, 441 bp, Homo sapiens; identical to SEQ ID NO: 535074
  misc_feature: HIJSMM301BM10U.11.3.A03.1.454.light.4.raw

SEQ ID NO: 547285 - DNA, 496 bp, Homo sapiens; identical to SEQ ID NO: 536248
  misc_feature: HIJSMM301BZLQ6.22.27.C05.1.454.light.4.raw

SEQ ID NO: 547286 - DNA, 498 bp, Homo sapiens
  misc_feature: HIJSMM301CL4OD.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcgcgacggaccgaaggtaggaagtaacaaacgaaaccgtaagtgg

SEQ ID NO: 547287 - DNA, 494 bp, Homo sapiens; identical to SEQ ID NO: 535478
  misc_feature: HIJSMM301ELU0G.10.79.H02.1.454.light.4.raw

SEQ ID NO: 547288 - DNA, 493 bp, Homo sapiens; identical to SEQ ID NO: 536246
  misc_feature: HIJSMM301A4N88.49.66.F11.1.454.light.4.raw

SEQ ID NO: 547289 - DNA, 474 bp, Homo sapiens
  misc_feature: HIJSMM301EL5X2.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgtaaggggaaagtaatgaagttaacactgtggatcaccttcggccaagggacacgactggagattaaacgactgtggctgcacatctgtcttcatcttcccgccatctgaagtatagtct

SEQ ID NO: 547290 - DNA, 378 bp, Homo sapiens
  misc_feature: HIJSMM301ETI4B.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 547291 - DNA, 472 bp, Homo sapiens; identical to SEQ ID NO: 540871
  misc_feature: HIJSMM301ECXDJ.13.48.E04.1.454.light.4.raw

SEQ ID NO: 547292 - DNA, 524 bp, Homo sapiens
  misc_feature: HIJSMM301CW757.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacggaccgaaggtacggaaggtacgaaacgaaacgtagtaggcgtgcgaccaactctgtcttctactcttcccgtcccact

SEQ ID NO: 547293 - DNA, 496 bp, Homo sapiens; identical to SEQ ID NO: 539822
  misc_feature: HIJSMM301BLBRO.18.11.A11.1.454.light.4.raw

SEQ ID NO: 547294 - DNA, 491 bp, Homo sapiens
  misc_feature: HIJSMM301CYM47.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccggggatccctgagagattctctggctccacctcagggcaatggccaccttgactatcagtggcgcccaggtggaggatgaggctgactta

SEQ ID NO: 547295 - DNA, 494 bp, Homo sapiens; identical to SEQ ID NO: 534992
  misc_feature: HIJSMM301BS0HH.9.1.A01.1.454.light.4.raw

SEQ ID NO: 547296 - DNA, 473 bp, Homo sapiens; identical to SEQ ID NO: 535262
  misc_feature: HIJSMM301BAX9S.8.67.G01.1.454.light.4.raw

SEQ ID NO: 547297 - DNA, 491 bp, Homo sapiens; identical to SEQ ID NO: 543766
  misc_feature: HIJSMM301AK9H2.11.81.H04.1.454.light.4.raw

SEQ ID NO: 547298 - DNA, 495 bp, Homo sapiens
  misc_feature: HIJSMM301BZU8B.41.20.B09.1.454.light.4.raw
tctatactatcacgaccggtgctcgatttagtgtagtgtgaaggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggactgtggctgcaccatctgtcttcatcttcccgcca

SEQ ID NO: 547299 - DNA, 507 bp, Homo sapiens
  misc_feature: HIJSMM301CPN3F.48.53.E09.1.454.light.4.raw
agtatacatacacgaccggtgctcgatttagagagagtgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggcctcccagacctcctcatctatgatgcgtctaccagggccacgtggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 547300 - DNA, 488 bp, Homo sapiens; identical to SEQ ID NO: 536861
  misc_feature: HIJSMM301EY6H6.12.88.H11.1.454.light.4.raw

SEQ ID NO: 547301 - DNA, 517 bp, Homo sapiens
  misc_feature: HIJSMM301CIDIS.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcactc

SEQ ID NO: 547302 - DNA, 509 bp, Homo sapiens
  misc_feature: HIJSMM301CFVXD.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccg

SEQ ID NO: 547303 - DNA, 503 bp, Homo sapiens
  misc_feature: HIJSMM301DFV3L.48.57.F02.1.454.light.4.raw
agtatacatacacgaccggtgctcgatttagctcgatatagttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 547304 - DNA, 493 bp, Homo sapiens
  misc_feature: HIJSMM301AEAGL.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccgaaggtaggaaagtacaaacgaaactagtggctgcaccatctgtcttcta

SEQ ID NO: 547305 - DNA, 510 bp, Homo sapiens; identical to SEQ ID NO: 535855
  misc_feature: HIJSMM301EOOAD.17.33.C11.1.454.light.4.raw

SEQ ID NO: 547306 - DNA, 504 bp, Homo sapiens
  misc_feature: HIJSMM301BSUJ4.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtcaaacgaactgtggctgcaccatctgtcttcatt

SEQ ID NO: 547307 - DNA, 502 bp, Homo sapiens
  misc_feature: HIJSMM301CCFNQ.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgagggtgcagagaactccatggctaccaggtcagcccaaggccaaccccactgtcactctgttcccaccctcctcta

SEQ ID NO: 547308 - DNA, 513 bp, Homo sapiens
  misc_feature: HIJSMM301BWTUV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgtccacggaccgaacggtaggaagtactaacgaactagtggctgcaccactctgtcttctatcttcccgtccact

SEQ ID NO: 547309 - DNA, 520 bp, Homo sapiens; identical to SEQ ID NO: 538570
  misc_feature: HIJSMM301B2J98.27.23.C01.1.454.light.4.raw

SEQ ID NO: 547310 - DNA, 473 bp, Homo sapiens; identical to SEQ ID NO: 535262
  misc_feature: HIJSMM301A2ZCQ.8.67.G01.1.454.light.4.raw

SEQ ID NO: 547311 - DNA, 447 bp, Homo sapiens; identical to SEQ ID NO: 535020
  misc_feature: HIJSMM301AD94U.18.9.A09.1.454.light.4.raw

SEQ ID NO: 547312 - DNA, 502 bp, Homo sapiens
  misc_feature: HIJSMM301D8EUB.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagtcaaacgaactgtggctgcaccatctgtcttcatcttcccg

SEQ ID NO: 547313 - DNA, 518 bp, Homo sapiens; identical to SEQ ID NO: 544387
  misc_feature: HIJSMM301C1DRF.19.80.H03.1.454.light.4.raw

SEQ ID NO: 547314 - DNA, 495 bp, Homo sapiens
  misc_feature: HIJSMM301E2KBD.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggtccaagggacacgactggagattaaacgaactgtggctgcaccatctgtctt

SEQ ID NO: 547315 - DNA, 493 bp, Homo sapiens; identical to SEQ ID NO: 535566
  misc_feature: HIJSMM301CAUPC.16.6.A06.1.454.light.4.raw

SEQ ID NO: 547316 - DNA, 496 bp, Homo sapiens; identical to SEQ ID NO: 537513
  misc_feature: HIJSMM301B452Q.12.87.H10.1.454.light.4.raw

SEQ ID NO: 547317 - DNA, 454 bp, Homo sapiens; identical to SEQ ID NO: 536347
  misc_feature: HIJSMM301D56L6.19.86.H09.1.454.light.4.raw

SEQ ID NO: 547318 - DNA, 502 bp, Homo sapiens; identical to SEQ ID NO: 546060
  misc_feature: HIJSMM301A1G97.19.67.G01.1.454.light.4.raw

SEQ ID NO: 547319 - DNA, 459 bp, Homo sapiens
  misc_feature: HIJSMM301EFMFC.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgcctcctcacgcgtatgt

SEQ ID NO: 547320 - DNA, 492 bp, Homo sapiens
  misc_feature: HIJSMM301AI65U.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccaccctgctcg

SEQ ID NO: 547321 - DNA, 509 bp, Homo sapiens
  misc_feature: HIJSMM301DWEHF.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccta

SEQ ID NO: 547322 - DNA, 509 bp, Homo sapiens; identical to SEQ ID NO: 535670
  misc_feature: HIJSMM301CBHDC.47.23.C01.1.454.light.4.raw

SEQ ID NO: 547323 - DNA, 484 bp, Homo sapiens; identical to SEQ ID NO: 535400
  misc_feature: HIJSMM301A1ZMR.46.26.C04.1.454.light.4.raw

SEQ ID NO: 547324 - DNA, 466 bp, Homo sapiens; identical to SEQ ID NO: 535366
  misc_feature: HIJSMM301BKQX0.13.4.A04.1.454.light.4.raw

SEQ ID NO: 547325 - DNA, 516 bp, Homo sapiens; identical to SEQ ID NO: 535549
  misc_feature: HIJSMM301DSZM7.14.70.G04.1.454.light.4.raw

SEQ ID NO: 547326 - DNA, 500 bp, Homo sapiens
  misc_feature: HIJSMM301C00EH.49.62.F07.1.454.light.4.raw
agtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcggtggagtccaggcagaggacgaggctgactattattgtcaatcaacagacaccattggtacttatgtcttcggaactgcgaccaaggtcaccgtcctgggtcagcccaaggccaaccccactcgtcactt

SEQ ID NO: 547327 - DNA, 495 bp, Homo sapiens; identical to SEQ ID NO: 538673
  misc_feature: HIJSMM301CTMTI.51.35.D02.1.454.light.4.raw

SEQ ID NO: 547328 - DNA, 494 bp, Homo sapiens
  misc_feature: HIJSMM301AM9PD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgtcagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgaggagatcacgacgaactacgtggcgcgtcgaccactctcgtcttcta

SEQ ID NO: 547329 - DNA, 500 bp, Homo sapiens
  misc_feature: HIJSMM301A1K8Z.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtca

SEQ ID NO: 547330 - DNA, 500 bp, Homo sapiens; identical to SEQ ID NO: 544587
  misc_feature: HIJSMM301C9VVK.43.34.D01.1.454.light.4.raw

SEQ ID NO: 547331 - DNA, 487 bp, Homo sapiens
  misc_feature: HIJSMM301CIXZU.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgctagttttggccaggggaccaaggtggagatcaaacgaactgtggctgcacatctgtcttcatt

SEQ ID NO: 547332 - DNA, 513 bp, Homo sapiens
  misc_feature: HIJSMM301EP7T5.17.33.C11.1.454.light.4.raw
cgtagactagcacgaccggtgctcgatttagagtgagctcgttgggtttggggggcgccaggggtcccttccaatatcagcaccatggtctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcct

SEQ ID NO: 547333 - DNA, 495 bp, Homo sapiens; identical to SEQ ID NO: 536055
  misc_feature: HIJSMM301AXHR5.47.38.D05.1.454.light.4.raw

SEQ ID NO: 547334 - DNA, 484 bp, Homo sapiens
  misc_feature: HIJSMM301BIGJQ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaa

SEQ ID NO: 547335 - DNA, 481 bp, Homo sapiens
  misc_feature: HIJSMM301CCEJY.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaaccaccctgcgtggttttggctgttcggcggcgggacc

SEQ ID NO: 547336 - DNA, 508 bp, Homo sapiens
  misc_feature: HIJSMM301CUCSJ.43.72.G06.1.454.light.4.raw
tgtgagtagtcacgaccggtgctcgatttagctacgactgcaagggaaaggggctgggcctcaggaagcagcatcgggggtgccgcagccatggcctggaccgctctccttctgagcctccttgctcactttacaggttctgtggcctcctatgagctgactcagccactctcagtgtcagtggccctgggacaggcggccaagataacctgtgggggaaacaacattggagataagagtgtccactggtatcaccagaagccaggccaggcccctgtgttggtcatctatagagataccagccggccctctgggatccctgagcgattctctggctccaactcggggaacacggccaccctgaccatcagcagagcccaagccggggatgagggtgactattactgtcaggtgtgggacagcaacactgtgattttcggcggaggggccaagttgaccgtgctaggtcagcccaaggctgccccctcggtcactctgttcccgccct

SEQ ID NO: 547337 - DNA, 501 bp, Homo sapiens
  misc_feature: HIJSMM301AV04V.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagattttgcagtttattattgtcagcagtataataactggcctccgtggacgttcggccaagggaccaaggtggaaatcaaacgaactagtggctgcaccatctgtcttcta

SEQ ID NO: 547338 - DNA, 513 bp, Homo sapiens; identical to SEQ ID NO: 535244
  misc_feature: HIJSMM301C8LGI.17.33.C11.1.454.light.4.raw

SEQ ID NO: 547339 - DNA, 493 bp, Homo sapiens; identical to SEQ ID NO: 535745
  misc_feature: HIJSMM301AYNBD.47.78.H01.1.454.light.4.raw

SEQ ID NO: 547340 - DNA, 490 bp, Homo sapiens; identical to SEQ ID NO: 541407
  misc_feature: HIJSMM301BA1G2.14.55.E11.1.454.light.4.raw

SEQ ID NO: 547341 - DNA, 497 bp, Homo sapiens; identical to SEQ ID NO: 536376
  misc_feature: HIJSMM301B8IMX.22.9.A09.1.454.light.4.raw

SEQ ID NO: 547342 - DNA, 479 bp, Homo sapiens; identical to SEQ ID NO: 535586
  misc_feature: HIJSMM301AFZ8R.13.34.D01.1.454.light.4.raw

SEQ ID NO: 547343 - DNA, 476 bp, Homo sapiens; identical to SEQ ID NO: 541471
  misc_feature: HIJSMM301B510P.13.4.A04.1.454.light.4.raw

SEQ ID NO: 547344 - DNA, 506 bp, Homo sapiens; identical to SEQ ID NO: 538355
  misc_feature: HIJSMM301A5S8U.10.27.C05.1.454.light.4.raw

SEQ ID NO: 547345 - DNA, 486 bp, Homo sapiens
  misc_feature: HIJSMM301EBE8P.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgttcccaccctcctctacgtgagct

SEQ ID NO: 547346 - DNA, 494 bp, Homo sapiens; identical to SEQ ID NO: 534992
  misc_feature: HIJSMM301BR1XE.9.1.A01.1.454.light.4.raw

SEQ ID NO: 547347 - DNA, 490 bp, Homo sapiens
  misc_feature: HIJSMM301ARSFV.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttatactgtcagcaatattatagtactcctccgaggctcactttcggcggagggaccaaggtggagatcaaacgaa

SEQ ID NO: 547348 - DNA, 500 bp, Homo sapiens
  misc_feature: HIJSMM301DBLPG.48.28.C06.1.454.light.4.raw
agtatacatacacgaccggtgctcgatttagagctcacgtattgggtttgggagaggccctggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctccatctatgatgcgtctaccagggccactggcgtcccggccaggttcagtgccagtgggtctgggacagacttcactctcaccatccagcagcctagagcccgaagattttgcggtttattactgtcagcagcgtgccaactggcctctcacgttcggcgagggaccaaggtggacatcaacgaactgtggctgcaccatctgt

SEQ ID NO: 547349 - DNA, 498 bp, Homo sapiens
  misc_feature: HIJSMM301CA9W7.10.64.F09.1.454.light.4.raw
catagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctgggacagacttcactctcaccatcaccggcctagaccctgaagattttgcagtttattactgtcagcagcgtagcagctggcccctctccctcactttcggcggagggaccaaggtggagatcaaacgaactgtggctgcaccatctgtcttcgt

SEQ ID NO: 547350 - DNA, 489 bp, Homo sapiens; identical to SEQ ID NO: 544819
  misc_feature: HIJSMM301EYLOI.11.28.C06.1.454.light.4.raw

SEQ ID NO: 547351 - DNA, 490 bp, Homo sapiens; identical to SEQ ID NO: 537951
  misc_feature: HIJSMM301A4J1P.19.57.F02.1.454.light.4.raw

SEQ ID NO: 547352 - DNA, 507 bp, Homo sapiens; identical to SEQ ID NO: 538702
  misc_feature: HIJSMM301A8B60.11.57.F02.1.454.light.4.raw

SEQ ID NO: 547353 - DNA, 488 bp, Homo sapiens; identical to SEQ ID NO: 536056
  misc_feature: HIJSMM301BCUVE.47.36.D03.1.454.light.4.raw

SEQ ID NO: 547354 - DNA, 501 bp, Homo sapiens
  misc_feature: HIJSMM301DRQAF.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactgacaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactagtggctgcaccatctgtcttcatcttccccg

SEQ ID NO: 547355 - DNA, 476 bp, Homo sapiens; identical to SEQ ID NO: 543775
  misc_feature: HIJSMM301C3MZC.8.85.H08.1.454.light.4.raw

SEQ ID NO: 547356 - DNA, 494 bp, Homo sapiens; identical to SEQ ID NO: 534992
  misc_feature: HIJSMM301B1G7E.9.1.A01.1.454.light.4.raw

SEQ ID NO: 547357 - DNA, 488 bp, Homo sapiens
  misc_feature: HIJSMM301BJNRU.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggtcggagggaccgaaggtggagatcaagcgaactgtggctgcaccat

SEQ ID NO: 547358 - DNA, 501 bp, Homo sapiens
  misc_feature: HIJSMM301B6WQT.43.34.D01.1.454.light.4.raw
tgtgagtagtcacgaccggtgctcgatttagatcgtctgtgttggggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttcgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgttcttcggaattgggacgacggtcaccgtctaggtcagcccaaggccaacccac

SEQ ID NO: 547359 - DNA, 442 bp, Homo sapiens
  misc_feature: HIJSMM301DEUMG.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctctcgtactagacg

SEQ ID NO: 547360 - DNA, 504 bp, Homo sapiens; identical to SEQ ID NO: 535561
  misc_feature: HIJSMM301BX8XW.4.57.F02.1.454.light.4.raw

SEQ ID NO: 547361 - DNA, 497 bp, Homo sapiens; identical to SEQ ID NO: 536376
  misc_feature: HIJSMM301DQDFV.22.9.A09.1.454.light.4.raw

SEQ ID NO: 547362 - DNA, 455 bp, Homo sapiens
  misc_feature: HIJSMM301DH850.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccaccctcctccacgagagta

SEQ ID NO: 547363 - DNA, 486 bp, Homo sapiens
  misc_feature: HIJSMM301C4ZSN.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacgaccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 547364 - DNA, 500 bp, Homo sapiens
  misc_feature: HIJSMM301DYSYF.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaaacaaaaacctggccaggttcccaggctcctcgtctatgatgcgtccatcagggccactggcatcccagccaggttcagtggcaggtgggtctgggacagacttcactctcaccatcagcagcctagagcctgaagactttgctagtttattactgtcagcagcgtagctaatttgatcaccttcggccaagggacacgactaggaaattaacgaactgtggctgcaccatctgtcttcatccttcccgcc

SEQ ID NO: 547365 - DNA, 496 bp, Homo sapiens; identical to SEQ ID NO: 537225
  misc_feature: HIJSMM301CKC4O.11.59.F04.1.454.light.4.raw

SEQ ID NO: 547366 - DNA, 467 bp, Homo sapiens
  misc_feature: HIJSMM301AV3YJ.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggaggatcaaacgaa

SEQ ID NO: 547367 - DNA, 506 bp, Homo sapiens
  misc_feature: HIJSMM301ANU05.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcact

SEQ ID NO: 547368 - DNA, 350 bp, Homo sapiens; identical to SEQ ID NO: 537421
  misc_feature: HIJSMM301EAP9A.13.11.A11.1.454.light.4.raw

SEQ ID NO: 547369 - DNA, 484 bp, Homo sapiens; identical to SEQ ID NO: 540155
  misc_feature: HIJSMM301BTDOT.4.29.C07.1.454.light.4.raw

SEQ ID NO: 547370 - DNA, 486 bp, Homo sapiens; identical to SEQ ID NO: 537127
  misc_feature: HIJSMM301AR1A7.3.77.G11.1.454.light.4.raw

SEQ ID NO: 547371 - DNA, 506 bp, Homo sapiens; identical to SEQ ID NO: 544450
  misc_feature: HIJSMM301EMO0J.11.75.G09.1.454.light.4.raw

SEQ ID NO: 547372 - DNA, 515 bp, Homo sapiens
  misc_feature: HIJSMM301DKY58.43.81.H04.1.454.light.4.raw
tgtgagtagtcacgaccggtgctcgatttagtagtgtagattcgcggggtggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggactcgagttgaccgtcctaggtcagcccaaggctgccccctcggtcactctgttctcgccctcctcacta

SEQ ID NO: 547373 - DNA, 501 bp, Homo sapiens; identical to SEQ ID NO: 538431
  misc_feature: HIJSMM301DTJT2.21.22.B11.1.454.light.4.raw

SEQ ID NO: 547374 - DNA, 490 bp, Homo sapiens
  misc_feature: HIJSMM301AQFJO.41.68.G02.1.454.light.4.raw
tctatactatcacgaccggtgctcgatttagtcgatagtgaagggaaaggggagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttctaccatcaccagcctgcagcctgaagatattgcaacatattactgtcaacagtatgataatctccctcccacctttcggtcggagggaccgaaggtaggagatcaaacgaactagtggcgtgcaccatctgtt

SEQ ID NO: 547375 - DNA, 507 bp, Homo sapiens
  misc_feature: HIJSMM301DFBCM.49.87.H10.1.454.light.4.raw
  modified_base (234)..(234): a, c, t, g, unknown or other
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacngtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggcgggaccaggctgaccgtcctgggtcagcccaaggctgccccctcggtcactctgttccc

SEQ ID NO: 547376 - DNA, 509 bp, Homo sapiens; identical to SEQ ID NO: 547321
  misc_feature: HIJSMM301CUZPB.4.57.F02.1.454.light.4.raw

SEQ ID NO: 547377 - DNA, 488 bp, Homo sapiens; identical to SEQ ID NO: 535081
  misc_feature: HIJSMM301CT4ST.26.23.C01.1.454.light.4.raw

SEQ ID NO: 547378 - DNA, 502 bp, Homo sapiens
  misc_feature: HIJSMM301A2E7Q.48.28.C06.1.454.light.4.raw
agtatacatacacgaccggtgctcgatttagagctcacgtattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 547379 - DNA, 497 bp, Homo sapiens; identical to SEQ ID NO: 536462
  misc_feature: HIJSMM301AJVE5.41.20.B09.1.454.light.4.raw

SEQ ID NO: 547380 - DNA, 504 bp, Homo sapiens
  misc_feature: HIJSMM301CGVFR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactagtggctgcaccatctgtcttctatcttccccg

SEQ ID NO: 547381 - DNA, 515 bp, Homo sapiens
  misc_feature: HIJSMM301DM7AA.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccgcctcctcc

SEQ ID NO: 547382 - DNA, 506 bp, Homo sapiens; identical to SEQ ID NO: 539705
  misc_feature: HIJSMM301BAF6L.40.67.G01.1.454.light.4.raw

SEQ ID NO: 547383 - DNA, 505 bp, Homo sapiens
  misc_feature: HIJSMM301CZR0Z.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 547384 - DNA, 505 bp, Homo sapiens; identical to SEQ ID NO: 536233
  misc_feature: HIJSMM301CTMVM.48.25.C03.1.454.light.4.raw

SEQ ID NO: 547385 - DNA, 485 bp, Homo sapiens
  misc_feature: HIJSMM301C4H49.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaagggtggagatcaacgaa

SEQ ID NO: 547386 - DNA, 493 bp, Homo sapiens; identical to SEQ ID NO: 536007
  misc_feature: HIJSMM301B5QZ1.27.78.H01.1.454.light.4.raw

SEQ ID NO: 547387 - DNA, 523 bp, Homo sapiens
  misc_feature: HIJSMM301D5I82.41.19.B08.1.454.light.4.raw
tctatactatcacgaccggtgctcgatttagtgagtcagtaagggggggtctcaggaggcagcgctctcgggacgtctccaccatggcctgggctctgctatccctcaccctcctcactcagggcacagggtcctgggcccagtctgccctgactcaacctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctcatagta

SEQ ID NO: 547388 - DNA, 505 bp, Homo sapiens; identical to SEQ ID NO: 535987
  misc_feature: HIJSMM301EL9H5.18.37.D04.1.454.light.4.raw

SEQ ID NO: 547389 - DNA, 507 bp, Homo sapiens
  misc_feature: HIJSMM301BO5GQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaagtacaaacgaactagtggctgcaccatctgtcttcatcttccccg

SEQ ID NO: 547390 - DNA, 482 bp, Homo sapiens
  misc_feature: HIJSMM301C4IAU.48.38.D05.1.454.light.4.raw
agtatacatacacgaccggtgctcgatttagtatctgatagttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtgg

SEQ ID NO: 547391 - DNA, 472 bp, Homo sapiens
  misc_feature: HIJSMM301DYS58.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaa

SEQ ID NO: 547392 - DNA, 447 bp, Homo sapiens; identical to SEQ ID NO: 535201
  misc_feature: HIJSMM301A3D4Q.18.9.A09.1.454.light.4.raw

SEQ ID NO: 547393 - DNA, 486 bp, Homo sapiens; identical to SEQ ID NO: 535043
  misc_feature: HIJSMM301CNWKR.46.35.D02.1.454.light.4.raw

SEQ ID NO: 547394 - DNA, 496 bp, Homo sapiens
  misc_feature: HIJSMM301CWMSJ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggcagacttcactctcaccatcagcagcctagagcctgaagactttggactttattactgtcagcagcgtgagttctggcctccgctcactttcggcggagggaccagggtggaggatcaaacgaactgtggctgcaccatctgtcttcattcc

SEQ ID NO: 547395 - DNA, 520 bp, Homo sapiens; identical to SEQ ID NO: 537173
  misc_feature: HIJSMM301BFIDX.27.23.C01.1.454.light.4.raw

SEQ ID NO: 547396 - DNA, 490 bp, Homo sapiens; identical to SEQ ID NO: 535526
  misc_feature: HIJSMM301B18BQ.26.78.H01.1.454.light.4.raw

SEQ ID NO: 547397 - DNA, 503 bp, Homo sapiens
  misc_feature: HIJSMM301BNXEC.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 547398 - DNA, 486 bp, Homo sapiens; identical to SEQ ID NO: 535458
  misc_feature: HIJSMM301BDMOS.7.75.G09.1.454.light.4.raw

SEQ ID NO: 547399 - DNA, 497 bp, Homo sapiens
  misc_feature: HIJSMM301BGBZX.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggagatcaaacgaactgtggctgcaccatctgtctt

SEQ ID NO: 547400 - DNA, 514 bp, Homo sapiens; identical to SEQ ID NO: 543100
  misc_feature: HIJSMM301CFCUG.8.23.C01.1.454.light.4.raw

SEQ ID NO: 547401 - DNA, 486 bp, Homo sapiens; identical to SEQ ID NO: 535043
  misc_feature: HIJSMM301D92CM.46.35.D02.1.454.light.4.raw

SEQ ID NO: 547402 - DNA, 480 bp, Homo sapiens
  misc_feature: HIJSMM301BNHCB.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtggagatcaaacgaactgtggctgcacc

SEQ ID NO: 547403 - DNA, 514 bp, Homo sapiens; identical to SEQ ID NO: 541634
  misc_feature: HIJSMM301DDBM2.10.80.H03.1.454.light.4.raw

SEQ ID NO: 547404 - DNA, 487 bp, Homo sapiens
  misc_feature: HIJSMM301AG84T.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatacatggtgcatcacgtttacaaagtggtgtcccatcaaggtttagtggcagtggatctgggacagagttcactctcaccatcaccagtctgcaacctgaagattttgcaacttactactgtcaacagagttacactagtcctccggtcactttcggcggcgggaccgaaggtggaggtcagacgaactgtggctgcacca

SEQ ID NO: 547405 - DNA, 500 bp, Homo sapiens
  misc_feature: HIJSMM301BTCYT.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccg

SEQ ID NO: 547406 - DNA, 464 bp, Homo sapiens
  misc_feature: HIJSMM301DCVSX.21.76.G10.1.454.light.4.raw
  modified_base (413)..(413): a, c, t, g, unknown or other
tcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcaggggtcccatctcggttcagtggcagtggatctgggacagatttcactctcaccatcagcagcctgcagcctgaagatgttgcaacttattactgtcaaaaatntagcagtgcccctctcactttcggcgcagggaccaaggtggacatcaaacg

SEQ ID NO: 547407 - DNA, 485 bp, Homo sapiens; identical to SEQ ID NO: 535606
  misc_feature: HIJSMM301AZG8T.47.46.E02.1.454.light.4.raw

SEQ ID NO: 547408 - DNA, 494 bp, Homo sapiens
  misc_feature: HIJSMM301BMRQG.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccgaaggtggaagtacaaacgaactgtggctgcaccatctgtcttcatcttccg

SEQ ID NO: 547409 - DNA, 514 bp, Homo sapiens
  misc_feature: HIJSMM301A6L5O.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtagac

SEQ ID NO: 547410 - DNA, 440 bp, Homo sapiens
  misc_feature: HIJSMM301CXA8D.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgcctcctcgtatctctcg

SEQ ID NO: 547411 - DNA, 505 bp, Homo sapiens
  misc_feature: HIJSMM301A3EWL.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggttatcaaacgaactgtggctgcaccatctgtctt

SEQ ID NO: 547412 - DNA, 505 bp, Homo sapiens; identical to SEQ ID NO: 535987
  misc_feature: HIJSMM301BLDVD.18.37.D04.1.454.light.4.raw

SEQ ID NO: 547413 - DNA, 504 bp, Homo sapiens
  misc_feature: HIJSMM301BAF39.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggtaattgggacgacggtcaccgtcctaggtcagcccaacggccaaccccta

SEQ ID NO: 547414 - DNA, 488 bp, Homo sapiens; identical to SEQ ID NO: 535990
  misc_feature: HIJSMM301AD3J0.11.28.C06.1.454.light.4.raw

SEQ ID NO: 547415 - DNA, 515 bp, Homo sapiens
  misc_feature: HIJSMM301AMS9E.48.78.H01.1.454.light.4.raw
agtatacatacacgaccggtgctcgatttagtgtgagtagtttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctcct

SEQ ID NO: 547416 - DNA, 511 bp, Homo sapiens
  misc_feature: HIJSMM301DEL2Z.51.27.C05.1.454.light.4.raw
cgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactc

SEQ ID NO: 547417 - DNA, 493 bp, Homo sapiens; identical to SEQ ID NO: 538397
  misc_feature: HIJSMM301B2JUO.26.78.H01.1.454.light.4.raw

SEQ ID NO: 547418 - DNA, 507 bp, Homo sapiens; identical to SEQ ID NO: 539817
  misc_feature: HIJSMM301CRK8M.5.24.C02.1.454.light.4.raw

SEQ ID NO: 547419 - DNA, 383 bp, Homo sapiens; identical to SEQ ID NO: 447524
  misc_feature: HIJSMM301BBPYQ.41.26.C04.1.454.light.4.raw

SEQ ID NO: 547420 - DNA, 513 bp, Homo sapiens
  misc_feature: HIJSMM301DPFRW.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccca

SEQ ID NO: 547421 - DNA, 502 bp, Homo sapiens
  misc_feature: HIJSMM301A9MGV.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactctgttccccg

SEQ ID NO: 547422 - DNA, 486 bp, Homo sapiens; identical to SEQ ID NO: 540808
  misc_feature: HIJSMM301CO95O.26.70.G04.1.454.light.4.raw

SEQ ID NO: 547423 - DNA, 474 bp, Homo sapiens
  misc_feature: HIJSMM301CKJDH.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtagggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtgg

SEQ ID NO: 547424 - DNA, 474 bp, Homo sapiens
  misc_feature: HIJSMM301CBPI1.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcacgaccccg

SEQ ID NO: 547425 - DNA, 498 bp, Homo sapiens; identical to SEQ ID NO: 537020
  misc_feature: HIJSMM301EK3QQ.26.26.C04.1.454.light.4.raw

SEQ ID NO: 547426 - DNA, 489 bp, Homo sapiens
  misc_feature: HIJSMM301DC6JF.22.86.H09.1.454.light.4.raw
acatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaaggctgaccgtcctaggtcagcccaa

SEQ ID NO: 547427 - DNA, 504 bp, Homo sapiens; identical to SEQ ID NO: 535561
  misc_feature: HIJSMM301B4P32.4.57.F02.1.454.light.4.raw

SEQ ID NO: 547428 - DNA, 494 bp, Homo sapiens; identical to SEQ ID NO: 535090
  misc_feature: HIJSMM301CQ356.27.78.H01.1.454.light.4.raw
  modified_base (403)..(403): a, c, t, g, unknown or other

SEQ ID NO: 547429 - DNA, 499 bp, Homo sapiens
  misc_feature: HIJSMM301DOD4V.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcgccaaggaccagggtggaaatacaaacgaactgtggctgcaccatctgtcttctatcttcccgccat

SEQ ID NO: 547430 - DNA, 494 bp, Homo sapiens; identical to SEQ ID NO: 534992
  misc_feature: HIJSMM301CPE13.9.1.A01.1.454.light.4.raw

SEQ ID NO: 547431 - DNA, 444 bp, Homo sapiens; identical to SEQ ID NO: 535192
  misc_feature: HIJSMM301DGLD5.5.9.A09.1.454.light.4.raw

SEQ ID NO: 547432 - DNA, 499 bp, Homo sapiens
  misc_feature: HIJSMM301EAYKC.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtagctcccgggacaacagtggtaaccatgtggtattcggcggaggggaccaaactgaccgtcctaggtcagcccaaggctgccccctcggtcactctgtt

SEQ ID NO: 547433 - DNA, 479 bp, Homo sapiens
  misc_feature: HIJSMM301CPCKG.41.5.A05.1.454.light.4.raw
tctatactatcacgaccggtgctcgatttagatagatagacaggggagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccatctgtctt

SEQ ID NO: 547434 - DNA, 471 bp, Homo sapiens
  misc_feature: HIJSMM301ES1ZN.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaaactgtggctgcacc

SEQ ID NO: 547435 - DNA, 512 bp, Homo sapiens
  misc_feature: HIJSMM301DDSTF.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctcta

SEQ ID NO: 547436 - DNA, 508 bp, Homo sapiens; identical to SEQ ID NO: 537954
  misc_feature: HIJSMM301AZWA0.4.57.F02.1.454.light.4.raw

SEQ ID NO: 547437 - DNA, 474 bp, Homo sapiens
  misc_feature: HIJSMM301DKJEV.3.56.F01.1.454.light.4.raw
agacgcactccacgaccggtgctcgatttagcagacgtctgaacacacaaagggggagtcagtcccaaccaggacacagcatggacatgagggtccctgcccagctcctggggctcctgctgctctggctctcaggtgccagatgtgacatccagatgacccagtctccaccctccctgtctgcttctgtaggagatagagtcatcatcacttgccaggcgagtcaagacattagtgacaatttaaattggtatcaccagaaaccaggggaagcccctaagctcctgatctacgatgcatccagtttgcaaacaggggtcccatcaaggttcagtggacgtggatctgggacagatttcacttgcaccatcagcggcctgcagcctgaagatgttggaacatattactgtcaacagtatgatcagctcctttctttcggccctgggaccaaagtggaaatcaggcgaactgtgg

SEQ ID NO: 547438 - DNA, 487 bp, Homo sapiens
  misc_feature: HIJSMM301COOY4.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccgcctcctc

SEQ ID NO: 547439 - DNA, 492 bp, Homo sapiens
  misc_feature: HIJSMM301CLII0.43.66.F11.1.454.light.4.raw
tgtgagtagtcacgaccggtgctcgatttagtcacgcgagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcacttcgccaggacacgactgagataacgaactagtggctgcaccatctgtcttcatcttccg

SEQ ID NO: 547440 - DNA, 483 bp, Homo sapiens
  misc_feature: HIJSMM301B00UF.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggccctggaccaagtggatatcaaacgaactgtggctgcaccatctgtt

SEQ ID NO: 547441 - DNA, 444 bp, Homo sapiens; identical to SEQ ID NO: 535192
  misc_feature: HIJSMM301AJFEA.5.9.A09.1.454.light.4.raw

SEQ ID NO: 547442 - DNA, 503 bp, Homo sapiens
  misc_feature: HIJSMM301AK40W.18.37.D04.1.454.light.4.raw
  modified_base (496)..(496): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgnaccatct

SEQ ID NO: 547443 - DNA, 522 bp, Homo sapiens
  misc_feature: HIJSMM301A0G1Q.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagtttaccgtcctacgtcagcccaaggctgccccctcggtcact

SEQ ID NO: 547444 - DNA, 489 bp, Homo sapiens; identical to SEQ ID NO: 535139
  misc_feature: HIJSMM301EQCZ0.14.55.E11.1.454.light.4.raw

SEQ ID NO: 547445 - DNA, 392 bp, Homo sapiens
  misc_feature: HIJSMM301DBHSL.10.86.H09.1.454.light.4.raw
catagtagtgcacgaccggtgctcgatttagtgctatagacttgggtttgggggctgtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 547446 - DNA, 445 bp, Homo sapiens
  misc_feature: HIJSMM301AMP8X.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctcgccccctcggtcactctgttcccaccctcctcagacgtatca

SEQ ID NO: 547447 - DNA, 497 bp, Homo sapiens; identical to SEQ ID NO: 537300
  misc_feature: HIJSMM301CTZYM.9.53.E09.1.454.light.4.raw

SEQ ID NO: 547448 - DNA, 497 bp, Homo sapiens; identical to SEQ ID NO: 535664
  misc_feature: HIJSMM301BEZWP.22.14.B03.1.454.light.4.raw

SEQ ID NO: 547449 - DNA, 495 bp, Homo sapiens
  misc_feature: HIJSMM301AFNGT.52.34.D01.1.454.light.4.raw
cgcagtacgacacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 547450 - DNA, 445 bp, Homo sapiens
  misc_feature: HIJSMM301BVEHC.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgtttcccaccctcctcagacgtatca

SEQ ID NO: 547451 - DNA, 487 bp, Homo sapiens; identical to SEQ ID NO: 538190
  misc_feature: HIJSMM301DO7IQ.47.70.G04.1.454.light.4.raw

SEQ ID NO: 547452 - DNA, 490 bp, Homo sapiens
  misc_feature: HIJSMM301AV1DT.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacggggaccgacggtcggtagtgtcaagacgaactgtggctgcaccact

SEQ ID NO: 547453 - DNA, 488 bp, Homo sapiens; identical to SEQ ID NO: 535861
  misc_feature: HIJSMM301CUBPF.14.55.E11.1.454.light.4.raw

SEQ ID NO: 547454 - DNA, 495 bp, Homo sapiens; identical to SEQ ID NO: 538651
  misc_feature: HIJSMM301CV9LH.10.79.H02.1.454.light.4.raw

SEQ ID NO: 547455 - DNA, 488 bp, Homo sapiens; identical to SEQ ID NO: 537124
  misc_feature: HIJSMM301A3UOK.11.25.C03.1.454.light.4.raw

SEQ ID NO: 547456 - DNA, 485 bp, Homo sapiens
  misc_feature: HIJSMM301C4L63.26.70.G04.1.454.light.4.raw
agactatactcacgaccggtgctcgatttagtgtagtgtgaagggaaaggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaaacgaactgtggctgcacca

SEQ ID NO: 547457 - DNA, 497 bp, Homo sapiens
  misc_feature: HIJSMM301DTP61.9.1.A01.1.454.light.4.raw
tgatacgtctcacgaccggtgctcgatttagacgtctcatcagggggaggctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtcgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcactcttccccg

SEQ ID NO: 547458 - DNA, 484 bp, Homo sapiens
  misc_feature: HIJSMM301DJ7MV.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgcctcctcgctacgtaga

SEQ ID NO: 547459 - DNA, 498 bp, Homo sapiens; identical to SEQ ID NO: 536879
  misc_feature: HIJSMM301AYZRU.22.14.B03.1.454.light.4.raw

SEQ ID NO: 547460 - DNA, 476 bp, Homo sapiens
  misc_feature: HIJSMM301CFYZM.3.1.A01.1.454.light.4.raw
agacgcactccacgaccggtgctcgatttagacgtctcatcaggggaggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaactgtggctgcacc

SEQ ID NO: 547461 - DNA, 480 bp, Homo sapiens; identical to SEQ ID NO: 535291
  misc_feature: HIJSMM301AT40A.22.59.F04.1.454.light.4.raw

SEQ ID NO: 547462 - DNA, 523 bp, Homo sapiens
  misc_feature: HIJSMM301CBU9X.8.20.B09.1.454.light.4.raw
ctcgcgtgtccacgaccggtgctcgatttagtgtagtgtgaagggagcaccgtggagaagacagtggcccctacagaatgttcataggttctcatccctcaccccccaccacgggagactagagctgcaggatcccaggggaggggtctctcctcgctcactgcacagggtcctgggcccagtctgtgctgacgcagccgccctcagtgtctggggccccagggcagagggtcgccatttcctgcactgggacgagctccaacatcggggcaggttatgatgtacactggtaccggcacctcccaggagaagcccccaaactcttcatctggggtaacaccaatcggccctcaggggtccctgaccgagtctcaggctccaagtctggcacctcagcctccctggccgtctcggggctccaggctgaggatgagggtgattattactgcctgtcctatgacaacagcctgaatatatgggtgttcggcggagggaccaaactgaccgtcctcagtcagacccg

SEQ ID NO: 547463 - DNA, 495 bp, Homo sapiens
  misc_feature: HIJSMM301BO595.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgctagtttattactgtcagcagcgtagcaactggcctcggacgttcggccgaagggaccaaagtggacatcaagcgaactgtggcgtgcaccactctgtt

SEQ ID NO: 547464 - DNA, 516 bp, Homo sapiens
  misc_feature: HIJSMM301DNYZ2.49.17.B06.1.454.light.4.raw
agtcgagagacacgaccggtgctcgatttagtcgatagtgaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccgccctcct

SEQ ID NO: 547465 - DNA, 475 bp, Homo sapiens
  misc_feature: HIJSMM301EMLSH.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 547466 - DNA, 494 bp, Homo sapiens; identical to SEQ ID NO: 542264
  misc_feature: HIJSMM301CD1DM.13.6.A06.1.454.light.4.raw

SEQ ID NO: 547467 - DNA, 481 bp, Homo sapiens
  misc_feature: HIJSMM301BEOAA.11.17.B06.1.454.light.4.raw
cgagagataccacgaccggtgctcgatttagtcgatagtgaagggggcaggagtcagtctcaatcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaacccgtcggacgtcgtcgacggacgaacggtaggaaagtacaaacgaaacacgtagcgtg

SEQ ID NO: 547468 - DNA, 493 bp, Homo sapiens
  misc_feature: HIJSMM301ECWO3.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttc

SEQ ID NO: 547469 - DNA, 479 bp, Homo sapiens; identical to SEQ ID NO: 537163
  misc_feature: HIJSMM301BI6DD.13.73.G07.1.454.light.4.raw

SEQ ID NO: 547470 - DNA, 486 bp, Homo sapiens; identical to SEQ ID NO: 537428
  misc_feature: HIJSMM301EJLCO.47.62.F07.1.454.light.4.raw

SEQ ID NO: 547471 - DNA, 483 bp, Homo sapiens; identical to SEQ ID NO: 544413
  misc_feature: HIJSMM301B1KFR.46.35.D02.1.454.light.4.raw

SEQ ID NO: 547472 - DNA, 497 bp, Homo sapiens; identical to SEQ ID NO: 534982
  misc_feature: HIJSMM301DOP8J.26.80.H03.1.454.light.4.raw

SEQ ID NO: 547473 - DNA, 491 bp, Homo sapiens; identical to SEQ ID NO: 543766
  misc_feature: HIJSMM301CFO7I.11.81.H04.1.454.light.4.raw

SEQ ID NO: 547474 - DNA, 479 bp, Homo sapiens
  misc_feature: HIJSMM301D8GWZ.41.17.B06.1.454.light.4.raw
tctatactatcacgaccggtgctcgatttagtcgatagtgaagggggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcaccat

SEQ ID NO: 547475 - DNA, 464 bp, Homo sapiens
  misc_feature: HIJSMM301A2Z4V.17.28.C06.1.454.light.4.raw
cgtagactagcacgaccggtgctcgatttagagctcacgtattgggtttgggggtgtggtggtctccactcccgcccagtctgtgctgactcagccaccctcagtgtctgggacccccgggctagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 547476 - DNA, 484 bp, Homo sapiens; identical to SEQ ID NO: 535400
  misc_feature: HIJSMM301EWLRO.46.26.C04.1.454.light.4.raw

SEQ ID NO: 547477 - DNA, 498 bp, Homo sapiens
  misc_feature: HIJSMM301AUFAL.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagtagggccactggtaccccagccaggttcagtggcagtgggtctgggacagagttcactctcaccatcagcagcctgcagtctgaagattttgcagtttattactgtcagcagtataattactggcctcgggacgttcggccaagggaccgaaggtaggaagtcaaacgaactagtggctgcaccatctgtcttcta

SEQ ID NO: 547478 - DNA, 512 bp, Homo sapiens
  misc_feature: HIJSMM301CN3CR.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgcctcctc

SEQ ID NO: 547479 - DNA, 479 bp, Homo sapiens
  misc_feature: HIJSMM301AGEAI.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatct

SEQ ID NO: 547480 - DNA, 457 bp, Homo sapiens
  misc_feature: HIJSMM301AMAMN.49.84.H07.1.454.light.4.raw
agtcgagagacacgaccggtgctcgatttagcagacgtctgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 547481 - DNA, 498 bp, Homo sapiens; identical to SEQ ID NO: 538056
  misc_feature: HIJSMM301AZKV8.15.25.C03.1.454.light.4.raw

SEQ ID NO: 547482 - DNA, 447 bp, Homo sapiens; identical to SEQ ID NO: 535201
  misc_feature: HIJSMM301CHAGW.18.9.A09.1.454.light.4.raw

SEQ ID NO: 547483 - DNA, 489 bp, Homo sapiens
  misc_feature: HIJSMM301BY8PU.51.36.D03.1.454.light.4.raw
cgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgggagcagctccaacatcggaactaatactgtgaactggtaccagcaactcccaggaacggcccccaaactcctcatctacagtaatagtcagcggccctcaggggtccctgaccgattctctggctccaagtctggctcctcagcctccctggccatcagtgggctccagtctgaggatgaggctgattattactgtgcagcgtgggatggcagcctgaatggttatgtcttcggaatagggaccaaggtcaccgtcct

SEQ ID NO: 547484 - DNA, 491 bp, Homo sapiens
  misc_feature: HIJSMM301ETAE0.48.28.C06.1.454.light.4.raw
agtatacatacacgaccggtgctcgatttagagctcacgtattgggttggggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 547485 - DNA, 485 bp, Homo sapiens; identical to SEQ ID NO: 536040
  misc_feature: HIJSMM301CXI0M.15.1.A01.1.454.light.4.raw

SEQ ID NO: 547486 - DNA, 498 bp, Homo sapiens
  misc_feature: HIJSMM301C5U5C.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccaaggtaggaggatcaaacgaaactgtggctgcaccatctgtcttcatcttcccgt

SEQ ID NO: 547487 - DNA, 486 bp, Homo sapiens; identical to SEQ ID NO: 535385
  misc_feature: HIJSMM301CZ47I.19.71.G05.1.454.light.4.raw

SEQ ID NO: 547488 - DNA, 478 bp, Homo sapiens; identical to SEQ ID NO: 535129
  misc_feature: HIJSMM301BH8GY.11.11.A11.1.454.light.4.raw

SEQ ID NO: 547489 - DNA, 496 bp, Homo sapiens; identical to SEQ ID NO: 537925
  misc_feature: HIJSMM301AP4H4.22.14.B03.1.454.light.4.raw

SEQ ID NO: 547490 - DNA, 443 bp, Homo sapiens; identical to SEQ ID NO: 544913
  misc_feature: HIJSMM301CY6IR.5.9.A09.1.454.light.4.raw

SEQ ID NO: 547491 - DNA, 517 bp, Homo sapiens
  misc_feature: HIJSMM301AOGWO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaccgaacggtagggaaagtacaaaacgaaacctagtggctggcaccatctgtcttctatctttccccg

SEQ ID NO: 547492 - DNA, 485 bp, Homo sapiens
  misc_feature: HIJSMM301BS4MN.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagcctccagtctgaggatgaggctgactattactgtcagacctggggcactggttatgtggttttcggcggagggaccaagctgaccgtcctaggtcagcccaaggctcg

SEQ ID NO: 547493 - DNA, 447 bp, Homo sapiens; identical to SEQ ID NO: 535020
  misc_feature: HIJSMM301CDHAW.18.9.A09.1.454.light.4.raw

SEQ ID NO: 547494 - DNA, 492 bp, Homo sapiens
  misc_feature: HIJSMM301EMFZY.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccg

SEQ ID NO: 547495 - DNA, 512 bp, Homo sapiens
  misc_feature: HIJSMM301CL9R0.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtaggaaagtacaagcgaacgtgtggcgtgcaccactctgtcttctactcttcccgt

SEQ ID NO: 547496 - DNA, 521 bp, Homo sapiens
  misc_feature: HIJSMM301AQENX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccacgggaccgaacggtaggaaggtacgaaacgaaactagtggcgtgtcgaccactctgtcttctatcttcccgtcccact

SEQ ID NO: 547497 - DNA, 496 bp, Homo sapiens; identical to SEQ ID NO: 535541
  misc_feature: HIJSMM301C43VB.3.33.C11.1.454.light.4.raw

SEQ ID NO: 547498 - DNA, 467 bp, Homo sapiens
  misc_feature: HIJSMM301BSACG.5.36.D03.1.454.light.4.raw
  modified_base (453)..(453): a, c, t, g, unknown or other
atcagacacgcacgaccggtgctcgatttagctgcgtcacgatctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacaggtggggtcccaccaacgttcagcggcagtggatctgggacagagttcactctcaccatcagcagcctgcagcctgacgatgtggcaaacttataactnccaacagtatgatt

SEQ ID NO: 547499 - DNA, 503 bp, Homo sapiens
  misc_feature: HIJSMM301C0PJ3.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtaggaaagtacaaacgaactagtggctgcaccactct

SEQ ID NO: 547500 - DNA, 508 bp, Homo sapiens
  misc_feature: HIJSMM301DH48V.15.59.F04.1.454.light.4.raw
  modified_base (452)..(452): a, c, t, g, unknown or other
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtnttcggcggagggaccaagctgaccgtcctaggtcagcccaaggctgccccctcggt

SEQ ID NO: 547501 - DNA, 484 bp, Homo sapiens; identical to SEQ ID NO: 535240
  misc_feature: HIJSMM301EQLUP.47.60.F05.1.454.light.4.raw

SEQ ID NO: 547502 - DNA, 444 bp, Homo sapiens; identical to SEQ ID NO: 534993
  misc_feature: HIJSMM301AXBNV.5.9.A09.1.454.light.4.raw

SEQ ID NO: 547503 - DNA, 472 bp, Homo sapiens; identical to SEQ ID NO: 536302
  misc_feature: HIJSMM301C37C6.18.76.G10.1.454.light.4.raw

SEQ ID NO: 547504 - DNA, 354 bp, Homo sapiens; identical to SEQ ID NO: 535026
  misc_feature: HIJSMM301AZRJB.19.22.B11.1.454.light.4.raw

SEQ ID NO: 547505 - DNA, 505 bp, Homo sapiens; identical to SEQ ID NO: 535987
  misc_feature: HIJSMM301CHHDP.18.37.D04.1.454.light.4.raw

SEQ ID NO: 547506 - DNA, 486 bp, Homo sapiens; identical to SEQ ID NO: 544919
  misc_feature: HIJSMM301A2Y1O.7.85.H08.1.454.light.4.raw

SEQ ID NO: 547507 - DNA, 501 bp, Homo sapiens
  misc_feature: HIJSMM301BJVR5.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccagggctgaccgtcctgagtcagcccaaggctcgccccctc

SEQ ID NO: 547508 - DNA, 485 bp, Homo sapiens; identical to SEQ ID NO: 535018
  misc_feature: HIJSMM301D9GWX.46.35.D02.1.454.light.4.raw

SEQ ID NO: 547509 - DNA, 489 bp, Homo sapiens; identical to SEQ ID NO: 535139
  misc_feature: HIJSMM301DV2CD.14.55.E11.1.454.light.4.raw

SEQ ID NO: 547510 - DNA, 493 bp, Homo sapiens; identical to SEQ ID NO: 537281
  misc_feature: HIJSMM301D6VVV.9.1.A01.1.454.light.4.raw

SEQ ID NO: 547511 - DNA, 503 bp, Homo sapiens
  misc_feature: HIJSMM301AMPTN.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaactgaccgtcctaggtcagcccaa

SEQ ID NO: 547512 - DNA, 508 bp, Homo sapiens
  misc_feature: HIJSMM301C7D2D.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtctcggtcagcccaaggctgcccctcgg

SEQ ID NO: 547513 - DNA, 454 bp, Homo sapiens; identical to SEQ ID NO: 534964
  misc_feature: HIJSMM301BMU1Q.19.86.H09.1.454.light.4.raw

SEQ ID NO: 547514 - DNA, 507 bp, Homo sapiens; identical to SEQ ID NO: 538063
  misc_feature: HIJSMM301AGJ7D.47.85.H08.1.454.light.4.raw

SEQ ID NO: 547515 - DNA, 453 bp, Homo sapiens; identical to SEQ ID NO: 535650
  misc_feature: HIJSMM301DG1D9.19.86.H09.1.454.light.4.raw

SEQ ID NO: 547516 - DNA, 454 bp, Homo sapiens
  misc_feature: HIJSMM301BNUNH.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaattcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccccactgtcactctgttcccaccctcctccatcgta

SEQ ID NO: 547517 - DNA, 497 bp, Homo sapiens
  misc_feature: HIJSMM301EN59F.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggaggacgaagctgaccgtcctgagtcagcccaaggctgccccctcggtcacttcc

SEQ ID NO: 547518 - DNA, 501 bp, Homo sapiens; identical to SEQ ID NO: 535873
  misc_feature: HIJSMM301CP7K1.17.27.C05.1.454.light.4.raw

SEQ ID NO: 547519 - DNA, 474 bp, Homo sapiens; identical to SEQ ID NO: 543944
  misc_feature: HIJSMM301D5D08.5.70.G04.1.454.light.4.raw

SEQ ID NO: 547520 - DNA, 502 bp, Homo sapiens
  misc_feature: HIJSMM301AIXE8.48.37.D04.1.454.light.4.raw
agtatacatacacgaccggtgctcgatttagtagcatactgttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgtt

SEQ ID NO: 547521 - DNA, 485 bp, Homo sapiens; identical to SEQ ID NO: 536210
  misc_feature: HIJSMM301DU9MZ.43.54.E10.1.454.light.4.raw

SEQ ID NO: 547522 - DNA, 486 bp, Homo sapiens; identical to SEQ ID NO: 535043
  misc_feature: HIJSMM301B1X1S.46.35.D02.1.454.light.4.raw

SEQ ID NO: 547523 - DNA, 470 bp, Homo sapiens
  misc_feature: HIJSMM301CCMQT.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaa

SEQ ID NO: 547524 - DNA, 508 bp, Homo sapiens
  misc_feature: HIJSMM301A45UT.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccacaaagcggggacccagaccctggagcctcagttggaagcagccgatccagcctgcggagcctgtgggcaggtcagcccaaggccaaccccactgtcact

SEQ ID NO: 547525 - DNA, 485 bp, Homo sapiens; identical to SEQ ID NO: 535363
  misc_feature: HIJSMM301ALIAK.17.26.C04.1.454.light.4.raw

SEQ ID NO: 547526 - DNA, 495 bp, Homo sapiens; identical to SEQ ID NO: 535007
  misc_feature: HIJSMM301C6NIW.22.5.A05.1.454.light.4.raw

SEQ ID NO: 547527 - DNA, 507 bp, Homo sapiens
  misc_feature: HIJSMM301BIDYY.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccat

SEQ ID NO: 547528 - DNA, 494 bp, Homo sapiens
  misc_feature: HIJSMM301AI1OG.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactagtggctgcaccatctgt

SEQ ID NO: 547529 - DNA, 485 bp, Homo sapiens; identical to SEQ ID NO: 535880
  misc_feature: HIJSMM301EHBXZ.7.75.G09.1.454.light.4.raw

SEQ ID NO: 547530 - DNA, 484 bp, Homo sapiens; identical to SEQ ID NO: 535400
  misc_feature: HIJSMM301EWW7Z.46.26.C04.1.454.light.4.raw

SEQ ID NO: 547531 - DNA, 494 bp, Homo sapiens; identical to SEQ ID NO: 535629
  misc_feature: HIJSMM301A6OJY.4.27.C05.1.454.light.4.raw

SEQ ID NO: 547532 - DNA, 505 bp, Homo sapiens
  misc_feature: HIJSMM301DSTYQ.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccaccct

SEQ ID NO: 547533 - DNA, 484 bp, Homo sapiens
  misc_feature: HIJSMM301D2YRF.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaactgtggctgcacc

SEQ ID NO: 547534 - DNA, 517 bp, Homo sapiens; identical to SEQ ID NO: 536262
  misc_feature: HIJSMM301AEFOB.14.70.G04.1.454.light.4.raw

SEQ ID NO: 547535 - DNA, 383 bp, Homo sapiens; identical to SEQ ID NO: 447524
  misc_feature: HIJSMM301BQU4Z.41.26.C04.1.454.light.4.raw

SEQ ID NO: 547536 - DNA, 512 bp, Homo sapiens
  misc_feature: HIJSMM301DP6ME.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatccacgggggcccaggcagatgatgaatctaattatcactgtgcgttgtatatgggttttggcatttcggtgttcggcggagggacccaggtgaccgtcctacgtcagcccaagg

SEQ ID NO: 547537 - DNA, 482 bp, Homo sapiens
  misc_feature: HIJSMM301CDANJ.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttggccaggggaccaaaggtcgaaatgagacgaactgtggctgcaccat

SEQ ID NO: 547538 - DNA, 501 bp, Homo sapiens
  misc_feature: HIJSMM301AVY3J.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcta

SEQ ID NO: 547539 - DNA, 495 bp, Homo sapiens; identical to SEQ ID NO: 538651
  misc_feature: HIJSMM301EGHIS.10.79.H02.1.454.light.4.raw

SEQ ID NO: 547540 - DNA, 491 bp, Homo sapiens; identical to SEQ ID NO: 535294
  misc_feature: HIJSMM301CKK2E.16.68.G02.1.454.light.4.raw

SEQ ID NO: 547541 - DNA, 491 bp, Homo sapiens; identical to SEQ ID NO: 536211
  misc_feature: HIJSMM301A8ONJ.16.53.E09.1.454.light.4.raw

SEQ ID NO: 547542 - DNA, 508 bp, Homo sapiens
  misc_feature: HIJSMM301DEOKE.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgtttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccgggggaccgaccgtggaaatcaaacgaaactgtggctgcaccatctgtctt

SEQ ID NO: 547543 - DNA, 491 bp, Homo sapiens
  misc_feature: HIJSMM301A2EXU.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttatactgtcaacaatattatattattccgaggacgttcggccaagggaccaaggtggaaatcaaacgaactgtggctgcaccatctgtcttcatcttcccgccat

SEQ ID NO: 547544 - DNA, 502 bp, Homo sapiens
  misc_feature: HIJSMM301BJVOK.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 547545 - DNA, 483 bp, Homo sapiens; identical to SEQ ID NO: 535413
  misc_feature: HIJSMM301C2EX9.26.78.H01.1.454.light.4.raw

SEQ ID NO: 547546 - DNA, 501 bp, Homo sapiens
  misc_feature: HIJSMM301A1RTR.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaattgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctggtgttcggcggagggaccaaactgaccgtcctaggtcagcccaaggctgccccctcggtcactctgtt

SEQ ID NO: 547547 - DNA, 486 bp, Homo sapiens; identical to SEQ ID NO: 535385
  misc_feature: HIJSMM301AI3JY.19.71.G05.1.454.light.4.raw

SEQ ID NO: 547548 - DNA, 485 bp, Homo sapiens
  misc_feature: HIJSMM301DHTWF.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacagggtcccatcaaggttcaggggaagtggatctgggacagattttagtttcaccatcagcagcctgcagcctgaagatattggaacatattactgtcaacagtatgataatttaccgctcactttcggcgagggaccaaggtggacatcaaacgaactgtggctgcaccat

SEQ ID NO: 547549 - DNA, 488 bp, Homo sapiens
  misc_feature: HIJSMM301C2QW3.41.2.A02.1.454.light.4.raw
tctatactatcacgaccggtgctcgatttagactcatctacagggggaggtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatt

SEQ ID NO: 547550 - DNA, 444 bp, Homo sapiens; identical to SEQ ID NO: 540477
  misc_feature: HIJSMM301BCR1O.17.21.B10.1.454.light.4.raw

SEQ ID NO: 547551 - DNA, 454 bp, Homo sapiens; identical to SEQ ID NO: 534964
  misc_feature: HIJSMM301CVZEO.19.86.H09.1.454.light.4.raw

SEQ ID NO: 547552 - DNA, 486 bp, Homo sapiens
  misc_feature: HIJSMM301C5S1D.19.71.G05.1.454.light.4.raw
  modified_base (406)..(406): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtggcagtttatattgtcaacaattattattatacttcgtggacgttcggccaagggaccaaggtggatatcagacgaa

SEQ ID NO: 547553 - DNA, 518 bp, Homo sapiens
  misc_feature: HIJSMM301CA0UP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaaggtaggaagtacgaacgaactacgtggcgtgcaccactctgtcttctatcttcccgtcccact

SEQ ID NO: 547554 - DNA, 444 bp, Homo sapiens; identical to SEQ ID NO: 534993
  misc_feature: HIJSMM301ASRF2.5.9.A09.1.454.light.4.raw

SEQ ID NO: 547555 - DNA, 517 bp, Homo sapiens; identical to SEQ ID NO: 546084
  misc_feature: HIJSMM301AQDQ5.47.53.E09.1.454.light.4.raw

SEQ ID NO: 547556 - DNA, 503 bp, Homo sapiens; identical to SEQ ID NO: 538973
  misc_feature: HIJSMM301BHEPI.5.86.H09.1.454.light.4.raw

SEQ ID NO: 547557 - DNA, 487 bp, Homo sapiens
  misc_feature: HIJSMM301CVD69.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccaggggacacgactggagattaaacgaactgtggctgcaccatctgtt

SEQ ID NO: 547558 - DNA, 495 bp, Homo sapiens
  misc_feature: HIJSMM301C4S1S.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaaggctgaccgtcctaggtcagcccaagg

SEQ ID NO: 547559 - DNA, 494 bp, Homo sapiens; identical to SEQ ID NO: 534992
  misc_feature: HIJSMM301D8Y0Y.9.1.A01.1.454.light.4.raw

SEQ ID NO: 547560 - DNA, 518 bp, Homo sapiens
  misc_feature: HIJSMM301AJD2A.8.43.D10.1.454.light.4.raw
ctcgcgtgtccacgaccggtgctcgatttagactagcagtaagggggcggccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtggttcggcggagggaccaagctgaccgtcctaggtcagcccaaggctgccccctccggtcactctgttcccgccctcctcgacacgcg

SEQ ID NO: 547561 - DNA, 495 bp, Homo sapiens
  misc_feature: HIJSMM301B0GEJ.3.58.F03.1.454.light.4.raw
agacgcactccacgaccggtgctcgatttagtctgatcgagaagggaaagggggaggaactgctcagttaggacccagagggaaccatggaagccccagctcagcttctcttcctcctgctactctggctcccagataccaccggagaagttgtgttgacacagtctccagccaccctgtctttgtctccgggggaaagagccaccctctcctgcagggccagtcagagtgttagcagatacttagcctggtaccaacagaaacctggccaggctcccaggctcctcatctatgatgcgtccaacagggccactggcatcccagccaggatcagtggcagtgggtctgggacagacttcactctcaccatcagtagcctagagcctcaagattttgcagtttattattgtcaccaccgagccacgttcggccaagggaccaaggtggaaatcaaacgaactgtggctgcaccatctgtcttcatcttcccgccat

SEQ ID NO: 547562 - DNA, 480 bp, Homo sapiens
  misc_feature: HIJSMM301C8WZI.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcacttttcggccctgggaccatagtggatatcaaacgaactgtggctgcaccatctgtt

SEQ ID NO: 547563 - DNA, 485 bp, Homo sapiens
  misc_feature: HIJSMM301BGV9K.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtaccaaggtggacatcagacgaactgtggctgcac

SEQ ID NO: 547564 - DNA, 473 bp, Homo sapiens
  misc_feature: HIJSMM301CTDRH.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtggagtggatctgggacagaattcactttcaccatcagcagcctgcaacctgaagatattgcaacatattactgtcaacagtatgatagtctggccgccttcggcggagggaccaaggtggagatcgaacgaactgtggctgcacc

SEQ ID NO: 547565 - DNA, 514 bp, Homo sapiens
  misc_feature: HIJSMM301BLTDG.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccactctgagacacgcga

SEQ ID NO: 547566 - DNA, 497 bp, Homo sapiens; identical to SEQ ID NO: 539058
  misc_feature: HIJSMM301DG48U.12.87.H10.1.454.light.4.raw

SEQ ID NO: 547567 - DNA, 454 bp, Homo sapiens; identical to SEQ ID NO: 534964
  misc_feature: HIJSMM301B7BFZ.19.86.H09.1.454.light.4.raw

SEQ ID NO: 547568 - DNA, 491 bp, Homo sapiens; identical to SEQ ID NO: 535315
  misc_feature: HIJSMM301CNIZE.14.55.E11.1.454.light.4.raw

SEQ ID NO: 547569 - DNA, 515 bp, Homo sapiens
  misc_feature: HIJSMM301CK1CM.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggcccaaccccactgtcactctgttcccca

SEQ ID NO: 547570 - DNA, 506 bp, Homo sapiens; identical to SEQ ID NO: 546197
  misc_feature: HIJSMM301A2RIJ.9.12.B01.1.454.light.4.raw

SEQ ID NO: 547571 - DNA, 485 bp, Homo sapiens; identical to SEQ ID NO: 536040
  misc_feature: HIJSMM301BUXI0.15.1.A01.1.454.light.4.raw

SEQ ID NO: 547572 - DNA, 491 bp, Homo sapiens
  misc_feature: HIJSMM301A9RP8.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccaggtggacgtcaaacgaactgtggctgcaccatctgtcttcatt

SEQ ID NO: 547573 - DNA, 501 bp, Homo sapiens; identical to SEQ ID NO: 535873
  misc_feature: HIJSMM301CL030.17.27.C05.1.454.light.4.raw

SEQ ID NO: 547574 - DNA, 495 bp, Homo sapiens
  misc_feature: HIJSMM301C4QXY.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggtcaggggacccaggtggagatcagacgaactgtggctgcaccatctgtcttcatcttcccg

SEQ ID NO: 547575 - DNA, 501 bp, Homo sapiens
  misc_feature: HIJSMM301D8VV7.7.71.G05.1.454.light.4.raw
cgtgtctctacacgaccggtgctcgatttagtgtcgtcgcaagagagaggggggagaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctggaccaaagtggatatcaacgaactgtggctgcaccatctgtctt

SEQ ID NO: 547576 - DNA, 498 bp, Homo sapiens
  misc_feature: HIJSMM301EB052.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttcta

SEQ ID NO: 547577 - DNA, 484 bp, Homo sapiens
  misc_feature: HIJSMM301DTO5C.48.9.A09.1.454.light.4.raw
agtatacatacacgaccggtgctcgatttagcgagacgcgcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgagggtggaaatcaacgaactgtggctgcaccatctgtctt

SEQ ID NO: 547578 - DNA, 502 bp, Homo sapiens; identical to SEQ ID NO: 536253
  misc_feature: HIJSMM301CTMRD.21.22.B11.1.454.light.4.raw

SEQ ID NO: 547579 - DNA, 476 bp, Homo sapiens
  misc_feature: HIJSMM301DQS7E.48.75.G09.1.454.light.4.raw
agtatacatacacgaccggtgctcgatttagtatagacatcagggggatcaggacttctcagttcatcttctcaccatgaggctccctcgctcagctcctggggcgtgctaatgctctggatccctcggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggaactgtggctgcaccatctgtcttcatcttcccgccatctgatatgtata

SEQ ID NO: 547580 - DNA, 480 bp, Homo sapiens
  misc_feature: HIJSMM301A10ND.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggaggatcaaacgaactgtggctgca

SEQ ID NO: 547581 - DNA, 501 bp, Homo sapiens
  misc_feature: HIJSMM301CYYHP.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaatttgggacgacggtcaccgtcctaggtcagcccaaggcccaacccca

SEQ ID NO: 547582 - DNA, 493 bp, Homo sapiens; identical to SEQ ID NO: 535657
  misc_feature: HIJSMM301EQYL5.27.78.H01.1.454.light.4.raw

SEQ ID NO: 547583 - DNA, 486 bp, Homo sapiens; identical to SEQ ID NO: 544539
  misc_feature: HIJSMM301DY47B.47.62.F07.1.454.light.4.raw

SEQ ID NO: 547584 - DNA, 447 bp, Homo sapiens; identical to SEQ ID NO: 535020
  misc_feature: HIJSMM301ATMKK.18.9.A09.1.454.light.4.raw

SEQ ID NO: 547585 - DNA, 507 bp, Homo sapiens
  misc_feature: HIJSMM301BEPL0.4.71.G05.1.454.light.4.raw
  modified_base (499)..(499): a, c, t, g, unknown or other
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgattaatttcgtgggtgttcggcggagggaccaaactgaccgtcctaggtcagccaaggctcgccccctcggtcnctctcgtt

SEQ ID NO: 547586 - DNA, 517 bp, Homo sapiens
  misc_feature: HIJSMM301BP1LG.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactactca

SEQ ID NO: 547587 - DNA, 505 bp, Homo sapiens
  misc_feature: HIJSMM301EJF8X.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgccctcctctacgtcgtat

SEQ ID NO: 547588 - DNA, 446 bp, Homo sapiens
  misc_feature: HIJSMM301CISW5.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccccctcctccataccgta

SEQ ID NO: 547589 - DNA, 355 bp, Homo sapiens
  misc_feature: HIJSMM301CF9KG.17.34.D01.1.454.light.4.raw
cgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtctt

SEQ ID NO: 547590 - DNA, 494 bp, Homo sapiens; identical to SEQ ID NO: 534992
  misc_feature: HIJSMM301B4RA7.9.1.A01.1.454.light.4.raw

SEQ ID NO: 547591 - DNA, 499 bp, Homo sapiens
  misc_feature: HIJSMM301EYFIL.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgccctcctcactactcaca

SEQ ID NO: 547592 - DNA, 494 bp, Homo sapiens; identical to SEQ ID NO: 534994
  misc_feature: HIJSMM301BJJYI.27.78.H01.1.454.light.4.raw

SEQ ID NO: 547593 - DNA, 485 bp, Homo sapiens
  misc_feature: HIJSMM301B0CPC.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaaactgtggctgcaccatctgtcttcatcttcctgccatctgactagtctacg

SEQ ID NO: 547594 - DNA, 516 bp, Homo sapiens
  misc_feature: HIJSMM301B38V7.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttcccg

SEQ ID NO: 547595 - DNA, 483 bp, Homo sapiens
  misc_feature: HIJSMM301E0FR5.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttatactgtcagcagtatcataactggccgctcaccttcggccaagggacacgactggagattaaacgaactgtggctgcaccat

SEQ ID NO: 547596 - DNA, 490 bp, Homo sapiens
  misc_feature: HIJSMM301DK88A.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctccg

SEQ ID NO: 547597 - DNA, 499 bp, Homo sapiens
  misc_feature: HIJSMM301C2ULV.43.14.B03.1.454.light.4.raw
tgtgagtagtcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccca

SEQ ID NO: 547598 - DNA, 485 bp, Homo sapiens; identical to SEQ ID NO: 536040
  misc_feature: HIJSMM301CAFBT.15.1.A01.1.454.light.4.raw

SEQ ID NO: 547599 - DNA, 516 bp, Homo sapiens
  misc_feature: HIJSMM301D9JXO.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggccctttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcact

SEQ ID NO: 547600 - DNA, 486 bp, Homo sapiens
  misc_feature: HIJSMM301A3RYA.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcaccatct

SEQ ID NO: 547601 - DNA, 454 bp, Homo sapiens
  misc_feature: HIJSMM301AMY6O.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagccaaggctcgcccctcggtcactctcgttcccaccctcctccacgagagta

SEQ ID NO: 547602 - DNA, 504 bp, Homo sapiens; identical to SEQ ID NO: 543615
  misc_feature: HIJSMM301CFKXK.11.67.G01.1.454.light.4.raw

SEQ ID NO: 547603 - DNA, 493 bp, Homo sapiens
  misc_feature: HIJSMM301DNTZS.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactatcagcagtataataactggttcctgctcactttcggcgggggaccaaggtggagatcaaacgaactgtggctgcaccatctgtt

SEQ ID NO: 547604 - DNA, 518 bp, Homo sapiens; identical to SEQ ID NO: 535407
  misc_feature: HIJSMM301A24YV.22.30.C08.1.454.light.4.raw

SEQ ID NO: 547605 - DNA, 485 bp, Homo sapiens
  misc_feature: HIJSMM301BS2JK.48.5.A05.1.454.light.4.raw
agtatacatacacgaccggtgctcgatttagatagatagacaggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtaggaaagtacaaacgaactagtggctgcaccatcttcg

SEQ ID NO: 547606 - DNA, 505 bp, Homo sapiens
  misc_feature: HIJSMM301B0MK5.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggccccaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctggtcactctgttccccg

SEQ ID NO: 547607 - DNA, 494 bp, Homo sapiens
  misc_feature: HIJSMM301A3ITV.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaaacttattactgtcatcagagtactactttacctcaagtgatcaccttcggccaagggacacgactggagattaaacgaactgtggctgcaccatctgt

SEQ ID NO: 547608 - DNA, 499 bp, Homo sapiens; identical to SEQ ID NO: 543887
  misc_feature: HIJSMM301BVCSE.10.65.F10.1.454.light.4.raw

SEQ ID NO: 547609 - DNA, 507 bp, Homo sapiens; identical to SEQ ID NO: 535641
  misc_feature: HIJSMM301COS4S.10.88.H11.1.454.light.4.raw

SEQ ID NO: 547610 - DNA, 486 bp, Homo sapiens; identical to SEQ ID NO: 535385
  misc_feature: HIJSMM301CESA7.19.71.G05.1.454.light.4.raw

SEQ ID NO: 547611 - DNA, 504 bp, Homo sapiens
  misc_feature: HIJSMM301BW3M7.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggggagagccaccctctcctgcagggccagtcagagtgttggcaacctcttagcctggtaccaaacaaaaacctggccaggctcccaggctcctcatctatgatgcatccacgagggccactggcatcccagccaggttcagtggcagtgggtctgagacagacttcactctcaccatcagtggcctcgagcctgaagattttgctagtttattactgtcagcagcgtagccactggctctctttcggcggagggaccaaggttgagatcaaacgaactgtggctgcaccatctgtcttcatcttccccg

SEQ ID NO: 547612 - DNA, 486 bp, Homo sapiens
  misc_feature: HIJSMM301DIFDI.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggccaaagtggatatcaaacgaactagtggctgcaccatctgtt

SEQ ID NO: 547613 - DNA, 484 bp, Homo sapiens; identical to SEQ ID NO: 535240
  misc_feature: HIJSMM301DQ495.47.60.F05.1.454.light.4.raw

SEQ ID NO: 547614 - DNA, 503 bp, Homo sapiens; identical to SEQ ID NO: 538884
  misc_feature: HIJSMM301DHY0P.27.78.H01.1.454.light.4.raw

SEQ ID NO: 547615 - DNA, 496 bp, Homo sapiens; identical to SEQ ID NO: 537476
  misc_feature: HIJSMM301EGLMJ.40.57.F02.1.454.light.4.raw

SEQ ID NO: 547616 - DNA, 469 bp, Homo sapiens; identical to SEQ ID NO: 536091
  misc_feature: HIJSMM301CSH63.3.82.H05.1.454.light.4.raw

SEQ ID NO: 547617 - DNA, 510 bp, Homo sapiens
  misc_feature: HIJSMM301B8I1Y.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccaccct

SEQ ID NO: 547618 - DNA, 509 bp, Homo sapiens; identical to SEQ ID NO: 539359
  misc_feature: HIJSMM301EC3PK.47.85.H08.1.454.light.4.raw

SEQ ID NO: 547619 - DNA, 487 bp, Homo sapiens; identical to SEQ ID NO: 546145
  misc_feature: HIJSMM301CQ0EP.12.31.C09.1.454.light.4.raw

SEQ ID NO: 547620 - DNA, 480 bp, Homo sapiens; identical to SEQ ID NO: 535442
  misc_feature: HIJSMM301EIEG6.41.17.B06.1.454.light.4.raw

SEQ ID NO: 547621 - DNA, 503 bp, Homo sapiens
  misc_feature: HIJSMM301C23K1.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttcccgcc

SEQ ID NO: 547622 - DNA, 442 bp, Homo sapiens
  misc_feature: HIJSMM301BDFV5.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcaccctcctccgtgtctgat

SEQ ID NO: 547623 - DNA, 516 bp, Homo sapiens; identical to SEQ ID NO: 543729
  misc_feature: HIJSMM301BX4WE.5.27.C05.1.454.light.4.raw

SEQ ID NO: 547624 - DNA, 501 bp, Homo sapiens
  misc_feature: HIJSMM301D5UQN.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctattcccgccctcctcagacgtatca

SEQ ID NO: 547625 - DNA, 511 bp, Homo sapiens
  misc_feature: HIJSMM301BZ7XZ.48.34.D01.1.454.light.4.raw
agtatacatacacgaccggtgctcgatttagatcgtctgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccaggtggtctgggacagacttcactctcaccatcagcagcctagagcccgaagtattttgcggttttattactgtcagcagcgtgccaactggcctctcacgttcggcggacgggaccaagggtggacatacaaacgactgtggctgcaccactctcgtcttcatccttccccg

SEQ ID NO: 547626 - DNA, 500 bp, Homo sapiens
  misc_feature: HIJSMM301BG6CJ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttccccgctgactttcggcggagggaccaaggtagagatcaaaggaactgtggctgcaccatctgtcttcatcttccgcc

SEQ ID NO: 547627 - DNA, 489 bp, Homo sapiens
  misc_feature: HIJSMM301BNVK7.43.9.A09.1.454.light.4.raw
tgtgagtagtcacgaccggtgctcgatttagcgagacgcgcagggcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaattacggttcagggaccgaa

SEQ ID NO: 547628 - DNA, 503 bp, Homo sapiens
  misc_feature: HIJSMM301B7HIA.48.23.C01.1.454.light.4.raw
agtatacatacacgaccggtgctcgatttagtacacgtgattagggattgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 547629 - DNA, 497 bp, Homo sapiens
  misc_feature: HIJSMM301EW1XV.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaaagcccccaaactcatgatttatgaggtcacaaagcggccctcaggggtccctgatcgcttctctgcctccaagtctggcaacacggcctccctgaccgtctctgggctccagcctgaggatgaggcctgattattactgcagctcatatgcaggcatcaacactgttttcggcggagggaccaagctgaccgtcctaggtcagccaaggctgccccctcggtcactctgttcccaccctcctcgagtgcgtct

SEQ ID NO: 547630 - DNA, 482 bp, Homo sapiens
  misc_feature: HIJSMM301A0C9U.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtacaaacgaactagtgg

SEQ ID NO: 547631 - DNA, 502 bp, Homo sapiens
  misc_feature: HIJSMM301ANPHR.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttactactgaaaatcagcagagtggagggctgaggatgttggggtttagttactgcatgcaagactctacaaactccttacactttggtccgacgggaccgaagctggagatcaaacgaactgtggtcg

SEQ ID NO: 547632 - DNA, 500 bp, Homo sapiens
  misc_feature: HIJSMM301CLY81.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgcccctcggtcactctgttcccaccctcctcgctacgtaga

SEQ ID NO: 547633 - DNA, 495 bp, Homo sapiens
  misc_feature: HIJSMM301ADEF2.27.78.H01.1.454.light.4.raw
  modified_base (361)..(361): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctggggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctnaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 547634 - DNA, 521 bp, Homo sapiens; identical to SEQ ID NO: 539470
  misc_feature: HIJSMM301CLA94.27.23.C01.1.454.light.4.raw

SEQ ID NO: 547635 - DNA, 494 bp, Homo sapiens
  misc_feature: HIJSMM301EI9Z0.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccgaggggaccaagctggagatcaaacgaactgtggctgcaccatctgtctt

SEQ ID NO: 547636 - DNA, 518 bp, Homo sapiens
  misc_feature: HIJSMM301C2ZQ2.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaaccccactgtcactctgttcccaccctcctccgtgt

SEQ ID NO: 547637 - DNA, 509 bp, Homo sapiens
  misc_feature: HIJSMM301BNNHY.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccg

SEQ ID NO: 547638 - DNA, 516 bp, Homo sapiens
  misc_feature: HIJSMM301ETO9M.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccgccctcct

SEQ ID NO: 547639 - DNA, 513 bp, Homo sapiens
  misc_feature: HIJSMM301EHRIQ.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 547640 - DNA, 496 bp, Homo sapiens; identical to SEQ ID NO: 546893
  misc_feature: HIJSMM301DJ5MX.51.35.D02.1.454.light.4.raw

SEQ ID NO: 547641 - DNA, 479 bp, Homo sapiens; identical to SEQ ID NO: 535665
  misc_feature: HIJSMM301A8Z7P.12.10.A10.1.454.light.4.raw

SEQ ID NO: 547642 - DNA, 487 bp, Homo sapiens; identical to SEQ ID NO: 543166
  misc_feature: HIJSMM301BKCZR.5.23.C01.1.454.light.4.raw

SEQ ID NO: 547643 - DNA, 494 bp, Homo sapiens; identical to SEQ ID NO: 534994
  misc_feature: HIJSMM301AV04O.27.78.H01.1.454.light.4.raw

SEQ ID NO: 547644 - DNA, 506 bp, Homo sapiens
  misc_feature: HIJSMM301AOOVT.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctgggtcagcccaaggctgcccctcggtcactctcgttcccgccctcctctacgtcgtat

SEQ ID NO: 547645 - DNA, 477 bp, Homo sapiens
  misc_feature: HIJSMM301EF3Z1.48.29.C07.1.454.light.4.raw
agtatacatacacgaccggtgctcgatttagagtgctacgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaatcatgatttatgatatcactaagcggccctcagggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtccg

SEQ ID NO: 547646 - DNA, 517 bp, Homo sapiens; identical to SEQ ID NO: 537838
  misc_feature: HIJSMM301AN0J1.7.86.H09.1.454.light.4.raw

SEQ ID NO: 547647 - DNA, 505 bp, Homo sapiens; identical to SEQ ID NO: 535503
  misc_feature: HIJSMM301BUYIU.8.28.C06.1.454.light.4.raw

SEQ ID NO: 547648 - DNA, 514 bp, Homo sapiens
  misc_feature: HIJSMM301C05N8.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 547649 - DNA, 496 bp, Homo sapiens
  misc_feature: HIJSMM301EIETA.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 547650 - DNA, 505 bp, Homo sapiens; identical to SEQ ID NO: 547532
  misc_feature: HIJSMM301ENF5V.8.1.A01.1.454.light.4.raw

SEQ ID NO: 547651 - DNA, 495 bp, Homo sapiens; identical to SEQ ID NO: 538651
  misc_feature: HIJSMM301B5YFR.10.79.H02.1.454.light.4.raw

SEQ ID NO: 547652 - DNA, 502 bp, Homo sapiens; identical to SEQ ID NO: 541971
  misc_feature: HIJSMM301AVV05.4.39.D06.1.454.light.4.raw

SEQ ID NO: 547653 - DNA, 518 bp, Homo sapiens; identical to SEQ ID NO: 537039
  misc_feature: HIJSMM301COEG4.49.10.A10.1.454.light.4.raw

SEQ ID NO: 547654 - DNA, 494 bp, Homo sapiens; identical to SEQ ID NO: 535276
  misc_feature: HIJSMM301A4PT8.16.6.A06.1.454.light.4.raw

SEQ ID NO: 547655 - DNA, 494 bp, Homo sapiens; identical to SEQ ID NO: 538230
  misc_feature: HIJSMM301BK8KI.11.71.G05.1.454.light.4.raw

SEQ ID NO: 547656 - DNA, 495 bp, Homo sapiens; identical to SEQ ID NO: 538673
  misc_feature: HIJSMM301CZNUI.51.35.D02.1.454.light.4.raw

SEQ ID NO: 547657 - DNA, 447 bp, Homo sapiens; identical to SEQ ID NO: 535020
  misc_feature: HIJSMM301A6JKA.18.9.A09.1.454.light.4.raw

SEQ ID NO: 547658 - DNA, 487 bp, Homo sapiens
  misc_feature: HIJSMM301CVZ3O.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgt

SEQ ID NO: 547659 - DNA, 459 bp, Homo sapiens
  misc_feature: HIJSMM301BGXFJ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagtccaaggctgccccctcggtcactctgttcccaccctcctcacgctatgt

SEQ ID NO: 547660 - DNA, 504 bp, Homo sapiens; identical to SEQ ID NO: 535561
  misc_feature: HIJSMM301EQBNR.4.57.F02.1.454.light.4.raw

SEQ ID NO: 547661 - DNA, 475 bp, Homo sapiens
  misc_feature: HIJSMM301CNKIN.52.77.G11.1.454.light.4.raw
  modified_base (454)..(454): a, c, t, g, unknown or other
cgcagtacgacacgaccggtgctcgatttagctagtcactcaagggaaaggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcgcgggggaccaaggtgngatcaacgaactgtgctgcac

SEQ ID NO: 547662 - DNA, 503 bp, Homo sapiens
  misc_feature: HIJSMM301CMBQZ.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggagggaccaaacgtgaccgtcctaggtcagcccaa

SEQ ID NO: 547663 - DNA, 484 bp, Homo sapiens
  misc_feature: HIJSMM301EIJE3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggactagacttcactctcaccatcagcagactggagcctgaagattttgcagtctattactgtcagcagtatggtcacgtccaagaactttggccagggaccaagctggagatcaaacgaactgtggctgcaccat

SEQ ID NO: 547664 - DNA, 463 bp, Homo sapiens
  misc_feature: HIJSMM301AMK6P.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagata

SEQ ID NO: 547665 - DNA, 444 bp, Homo sapiens; identical to SEQ ID NO: 537971
  misc_feature: HIJSMM301DHR3B.2.76.G10.1.454.light.4.raw

SEQ ID NO: 547666 - DNA, 529 bp, Homo sapiens
  misc_feature: HIJSMM301B93EL.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggatggtgattatgattatgtcttcggaactgggaccaaggtcaccgtcctaggtcacgcccaacggccaaacccccactgtcactcttgttccccaccctccctccgtcgtc

SEQ ID NO: 547667 - DNA, 485 bp, Homo sapiens; identical to SEQ ID NO: 545589
  misc_feature: HIJSMM301C32Z7.26.70.G04.1.454.light.4.raw

SEQ ID NO: 547668 - DNA, 454 bp, Homo sapiens
  misc_feature: HIJSMM301DS5RE.18.78.H01.1.454.light.4.raw
tacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccacccctcctccatactcgta

SEQ ID NO: 547669 - DNA, 493 bp, Homo sapiens; identical to SEQ ID NO: 539456
  misc_feature: HIJSMM301AZ20V.10.79.H02.1.454.light.4.raw

SEQ ID NO: 547670 - DNA, 361 bp, Homo sapiens; identical to SEQ ID NO: 540413
  misc_feature: HIJSMM301CBJWV.3.57.F02.1.454.light.4.raw

SEQ ID NO: 547671 - DNA, 479 bp, Homo sapiens; identical to SEQ ID NO: 537235
  misc_feature: HIJSMM301A53R4.22.59.F04.1.454.light.4.raw

SEQ ID NO: 547672 - DNA, 501 bp, Homo sapiens
  misc_feature: HIJSMM301BNA8H.53.30.C08.1.454.light.4.raw
cgcgtatacacacgaccggtgctcgatttagtctgacgtcaaagggaaagggggctgtgggctcaggaggcagagctctgggaatctcaccatggcctggacccctctcctgctccccctcctcacttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaagctgaccgtcctaggtcagcccaaggctgccccctcggtcact

SEQ ID NO: 547673 - DNA, 496 bp, Homo sapiens
  misc_feature: HIJSMM301BNQR7.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaagggaccaagctggagatcaaacgaaactgtggctgcaccatctgtctt

SEQ ID NO: 547674 - DNA, 497 bp, Homo sapiens; identical to SEQ ID NO: 538464
  misc_feature: HIJSMM301A2X0P.12.86.H09.1.454.light.4.raw

SEQ ID NO: 547675 - DNA, 487 bp, Homo sapiens; identical to SEQ ID NO: 536206
  misc_feature: HIJSMM301AG38O.47.38.D05.1.454.light.4.raw

SEQ ID NO: 547676 - DNA, 500 bp, Homo sapiens
  misc_feature: HIJSMM301A05LE.41.18.B07.1.454.light.4.raw
tctatactatcacgaccggtgctcgatttagtcgctgcgtaagggggggaggcctagctgtggtgtgggtccaggaggcagaactctgggtgtctcaccatggcctggatccctctacttctccccctccctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagccaacggctccg

SEQ ID NO: 547677 - DNA, 515 bp, Homo sapiens
  misc_feature: HIJSMM301B8K8S.15.34.D01.1.454.light.4.raw
tctacgtagccacgaccggtgctcgatttagatcgtctgtgttgggtttggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 547678 - DNA, 482 bp, Homo sapiens; identical to SEQ ID NO: 544665
  misc_feature: HIJSMM301BJ41O.8.14.B03.1.454.light.4.raw

SEQ ID NO: 547679 - DNA, 490 bp, Homo sapiens
  misc_feature: HIJSMM301CFAAJ.49.73.G07.1.454.light.4.raw
agtcgagagacacgaccggtgctcgatttagctctacgctcagggcacgaccggtgctcgatttagacacatacgcagggaaaggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggag

SEQ ID NO: 547680 - DNA, 484 bp, Homo sapiens
  misc_feature: HIJSMM301BULAU.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaa

SEQ ID NO: 547681 - DNA, 496 bp, Homo sapiens; identical to SEQ ID NO: 535109
  misc_feature: HIJSMM301AOCZ8.16.78.H01.1.454.light.4.raw

SEQ ID NO: 547682 - DNA, 487 bp, Homo sapiens
  misc_feature: HIJSMM301DE9DB.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 547683 - DNA, 492 bp, Homo sapiens; identical to SEQ ID NO: 536010
  misc_feature: HIJSMM301EDQI2.10.20.B09.1.454.light.4.raw

SEQ ID NO: 547684 - DNA, 496 bp, Homo sapiens
  misc_feature: HIJSMM301D0O97.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggaggttcaaacgaaactgtggctgcaccatctgtcttcatt

SEQ ID NO: 547685 - DNA, 498 bp, Homo sapiens
  misc_feature: HIJSMM301ARD3Z.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcat

SEQ ID NO: 547686 - DNA, 456 bp, Homo sapiens
  misc_feature: HIJSMM301CEX7Z.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtcctaagtcagcccaaggctgccccctcggtcactctgttcccaccctcctccacgagagta

SEQ ID NO: 547687 - DNA, 523 bp, Homo sapiens
  misc_feature: HIJSMM301CGCOW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccctaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccct

SEQ ID NO: 547688 - DNA, 508 bp, Homo sapiens
  misc_feature: HIJSMM301BPRGF.48.31.C09.1.454.light.4.raw
agtatacatacacgaccggtgctcgatttagacgtctcatcaaggaaggaagggggtcaggctggaactgaggagcaggtgggggcacttctccctctaacactctccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcta

SEQ ID NO: 547689 - DNA, 501 bp, Homo sapiens
  misc_feature: HIJSMM301BJR43.2.76.G10.1.454.light.4.raw
  modified_base (460)..(460): a, c, t, g, unknown or other
acgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttggt

SEQ ID NO: 547690 - DNA, 489 bp, Homo sapiens; identical to SEQ ID NO: 535139
  misc_feature: HIJSMM301AWLSE.14.55.E11.1.454.light.4.raw

SEQ ID NO: 547691 - DNA, 464 bp, Homo sapiens; identical to SEQ ID NO: 539492
  misc_feature: HIJSMM301AX4CU.18.59.F04.1.454.light.4.raw

SEQ ID NO: 547692 - DNA, 470 bp, Homo sapiens
  misc_feature: HIJSMM301BQWJ2.49.32.C10.1.454.light.4.raw
agtcgagagacacgaccggtgctcgatttagtatagacatcaacacacaaaggggcagtcccaaccaggacacagcatggacatgagggtccctgctcagctcctggggctcctgctgctctggctctcaggtgccagatgtatcatccagatgacccagtctccatcctccgtgtctgcatttataggagacagaatcaccatcacttgccgggcgagtcaggacattagcatgtatctgaattggtatcagcaaaaaccagggaaagcccctaagctcctgatcctcgatgcatccaatttggaaacagggtcccatcaaggttcagtgcaagtggctctgggacagatttcactttcaccatcagcagactgcagcctgaagatattgcaacatattactgtcaacagtatgataatcttccgctcactttcggcggagggaccaaggtggggatcagacgaactgt

SEQ ID NO: 547693 - DNA, 512 bp, Homo sapiens
  misc_feature: HIJSMM301CSDGO.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaagtaaaacgaactagtggctgcaccatctgtcttcta

SEQ ID NO: 547694 - DNA, 505 bp, Homo sapiens; identical to SEQ ID NO: 535987
  misc_feature: HIJSMM301AK040.18.37.D04.1.454.light.4.raw

SEQ ID NO: 547695 - DNA, 497 bp, Homo sapiens
  misc_feature: HIJSMM301AGZVW.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 547696 - DNA, 488 bp, Homo sapiens
  misc_feature: HIJSMM301C2PNM.5.7.A07.1.454.light.4.raw
atcagacacgcacgaccggtgctcgatttagcacgtgtcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgccgggcaagtcagaacattaccacctatttacattggtatctgcagaagccagggagagcccctaagctcctgatctatgcttcatccaatttgcacagtggggtcccgtcaaggttcagtggcggtggctctgagacagatttcactctcaccatcagcagtctgcaacctgaagtatttgcaacttactactgtcaacagagttaccggtacccccctcacctttcggcggacgggaccgaaggttagagatacaaacgaactgtggtctgcaccta

SEQ ID NO: 547697 - DNA, 485 bp, Homo sapiens
  misc_feature: HIJSMM301C5T0E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccatgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccctcactttcggcggagggaccaaggcggagatcagacgaactgtggctgcaccatctgtctt

SEQ ID NO: 547698 - DNA, 503 bp, Homo sapiens
  misc_feature: HIJSMM301BNMFJ.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggtcggagggaccgaacggtggagagtcaaacgaaactcgtggctg

SEQ ID NO: 547699 - DNA, 499 bp, Homo sapiens
  misc_feature: HIJSMM301BSYPR.53.30.C08.1.454.light.4.raw
cgcgtatacacacgaccggtgctcgatttagtctgacgtcaaagggaaagggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgtt

SEQ ID NO: 547700 - DNA, 493 bp, Homo sapiens; identical to SEQ ID NO: 535047
  misc_feature: HIJSMM301CWWA3.16.53.E09.1.454.light.4.raw

SEQ ID NO: 547701 - DNA, 489 bp, Homo sapiens; identical to SEQ ID NO: 535139
  misc_feature: HIJSMM301BZVWQ.14.55.E11.1.454.light.4.raw

SEQ ID NO: 547702 - DNA, 484 bp, Homo sapiens; identical to SEQ ID NO: 540581
  misc_feature: HIJSMM301CNHMM.3.88.H11.1.454.light.4.raw

SEQ ID NO: 547703 - DNA, 500 bp, Homo sapiens
  misc_feature: HIJSMM301AVV8O.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccta

SEQ ID NO: 547704 - DNA, 444 bp, Homo sapiens; identical to SEQ ID NO: 535192
  misc_feature: HIJSMM301CX46Z.5.9.A09.1.454.light.4.raw

SEQ ID NO: 547705 - DNA, 497 bp, Homo sapiens; identical to SEQ ID NO: 535764
  misc_feature: HIJSMM301CO88S.22.20.B09.1.454.light.4.raw

SEQ ID NO: 547706 - DNA, 476 bp, Homo sapiens
  misc_feature: HIJSMM301AM096.13.76.G10.1.454.light.4.raw
tcacgtactacacgaccggtgctcgatttagtcactcatacaggggtgggccccaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaagg

SEQ ID NO: 547707 - DNA, 507 bp, Homo sapiens
  misc_feature: HIJSMM301ATOT3.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagcccaccctggccatcagtgggctccggcccgaggatgaggctgattattactgtgtaggttggatcgcagcctgactgcttacgtcttcggagctgggaccaaggtcaccgtcctaggtcagcccaaggcccaaccc

SEQ ID NO: 547708 - DNA, 476 bp, Homo sapiens
  misc_feature: HIJSMM301D0RPI.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgt

SEQ ID NO: 547709 - DNA, 486 bp, Homo sapiens; identical to SEQ ID NO: 535043
  misc_feature: HIJSMM301AE78H.46.35.D02.1.454.light.4.raw

SEQ ID NO: 547710 - DNA, 500 bp, Homo sapiens
  misc_feature: HIJSMM301C5V3P.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcta

SEQ ID NO: 547711 - DNA, 532 bp, Homo sapiens
  misc_feature: HIJSMM301AFGV3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggacgaacggtaggaaggtacgaaacgaaactaagtaggtcgtgcgaccaactactcgtcttctactacttccctcctacctctctact

SEQ ID NO: 547712 - DNA, 463 bp, Homo sapiens; identical to SEQ ID NO: 547664
  misc_feature: HIJSMM301AQW3U.11.70.G04.1.454.light.4.raw

SEQ ID NO: 547713 - DNA, 519 bp, Homo sapiens
  misc_feature: HIJSMM301CARQ5.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgt

SEQ ID NO: 547714 - DNA, 447 bp, Homo sapiens; identical to SEQ ID NO: 535020
  misc_feature: HIJSMM301CMM11.18.9.A09.1.454.light.4.raw

SEQ ID NO: 547715 - DNA, 504 bp, Homo sapiens
  misc_feature: HIJSMM301DORG1.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggacgggacccacctgaccgtcttaggtcagcccaaggctgccccctcggtctac

SEQ ID NO: 547716 - DNA, 460 bp, Homo sapiens; identical to SEQ ID NO: 539553
  misc_feature: HIJSMM301AK99V.11.86.H09.1.454.light.4.raw

SEQ ID NO: 547717 - DNA, 487 bp, Homo sapiens; identical to SEQ ID NO: 536536
  misc_feature: HIJSMM301DV54D.26.45.E01.1.454.light.4.raw

SEQ ID NO: 547718 - DNA, 494 bp, Homo sapiens; identical to SEQ ID NO: 534994
  misc_feature: HIJSMM301CA8KD.27.78.H01.1.454.light.4.raw

SEQ ID NO: 547719 - DNA, 485 bp, Homo sapiens; identical to SEQ ID NO: 536576
  misc_feature: HIJSMM301EZAWQ.46.35.D02.1.454.light.4.raw

SEQ ID NO: 547720 - DNA, 486 bp, Homo sapiens
  misc_feature: HIJSMM301D5Q63.14.53.E09.1.454.light.4.raw
  modified_base (456)..(456): a, c, t, g, unknown or other
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtnttcggcggagggaccaagctgaccgtccta

SEQ ID NO: 547721 - DNA, 507 bp, Homo sapiens
  misc_feature: HIJSMM301ED2LL.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcatatacaaccagcagcactcgggtgttcggcggagggaccaagctgaccgtcctaggtcagcccaaggctgccccctggtcact

SEQ ID NO: 547722 - DNA, 492 bp, Homo sapiens; identical to SEQ ID NO: 535126
  misc_feature: HIJSMM301BI0LW.18.11.A11.1.454.light.4.raw

SEQ ID NO: 547723 - DNA, 441 bp, Homo sapiens; identical to SEQ ID NO: 535074
  misc_feature: HIJSMM301EJY86.11.3.A03.1.454.light.4.raw

SEQ ID NO: 547724 - DNA, 489 bp, Homo sapiens; identical to SEQ ID NO: 535139
  misc_feature: HIJSMM301BAZO9.14.55.E11.1.454.light.4.raw

SEQ ID NO: 547725 - DNA, 510 bp, Homo sapiens
  misc_feature: HIJSMM301D3AQT.8.33.C11.1.454.light.4.raw
ctcgcgtgtccacgaccggtgctcgatttagagtgagctcgttggggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactgggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccatctgtcttcta

SEQ ID NO: 547726 - DNA, 498 bp, Homo sapiens; identical to SEQ ID NO: 535974
  misc_feature: HIJSMM301BK8ZW.22.27.C05.1.454.light.4.raw

SEQ ID NO: 547727 - DNA, 473 bp, Homo sapiens; identical to SEQ ID NO: 535262
  misc_feature: HIJSMM301DWRMN.8.67.G01.1.454.light.4.raw

SEQ ID NO: 547728 - DNA, 492 bp, Homo sapiens
  misc_feature: HIJSMM301BXW0W.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggacgaacgacggagatcagacgaactgtggcgtgcaccaactctcgtcttcta

SEQ ID NO: 547729 - DNA, 510 bp, Homo sapiens; identical to SEQ ID NO: 545115
  misc_feature: HIJSMM301ESM5C.19.59.F04.1.454.light.4.raw

SEQ ID NO: 547730 - DNA, 454 bp, Homo sapiens; identical to SEQ ID NO: 534964
  misc_feature: HIJSMM301CYDVQ.19.86.H09.1.454.light.4.raw

SEQ ID NO: 547731 - DNA, 441 bp, Homo sapiens; identical to SEQ ID NO: 535074
  misc_feature: HIJSMM301EGLIO.11.3.A03.1.454.light.4.raw

SEQ ID NO: 547732 - DNA, 496 bp, Homo sapiens
  misc_feature: HIJSMM301A66US.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaagtaggacgatcaagcgaactagtggcgtgcaccatctgt

SEQ ID NO: 547733 - DNA, 485 bp, Homo sapiens; identical to SEQ ID NO: 538533
  misc_feature: HIJSMM301BE9M6.47.78.H01.1.454.light.4.raw

SEQ ID NO: 547734 - DNA, 404 bp, Homo sapiens; identical to SEQ ID NO: 535779
  misc_feature: HIJSMM301C143E.4.35.D02.1.454.light.4.raw

SEQ ID NO: 547735 - DNA, 491 bp, Homo sapiens; identical to SEQ ID NO: 536211
  misc_feature: HIJSMM301EXSPN.16.53.E09.1.454.light.4.raw

SEQ ID NO: 547736 - DNA, 503 bp, Homo sapiens
  misc_feature: HIJSMM301DK82D.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacgatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaagggaccaaggtggagatcaaaacgactgtggctgcaccatctgtctt

SEQ ID NO: 547737 - DNA, 503 bp, Homo sapiens
  misc_feature: HIJSMM301CRVYV.19.10.A10.1.454.light.4.raw
  modified_base (321)..(321): a, c, t, g, unknown or other
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctccctgcagggccgataacgagtgttgacagcaccttctttgcctggtaccagcagagacctggccaggctcccaggctcctcgtttatggtgcgtccaccagggccactggcatccccganaggttcagtggcagtgtgtctgggacagacttcactctcaccatcagcagactggagcctgaagatttgcagtgtattactgtcaacgatatgatgagtcacctccgtggtggacattggccaggggaccaaggttgaagtcaaacgaactgtggctgcaccatctgtcttcatcttccccg

SEQ ID NO: 547738 - DNA, 445 bp, Homo sapiens; identical to SEQ ID NO: 537719
  misc_feature: HIJSMM301BGKRW.47.85.H08.1.454.light.4.raw

SEQ ID NO: 547739 - DNA, 485 bp, Homo sapiens; identical to SEQ ID NO: 536576
  misc_feature: HIJSMM301AUX0S.46.35.D02.1.454.light.4.raw

SEQ ID NO: 547740 - DNA, 503 bp, Homo sapiens
  misc_feature: HIJSMM301BVPP3.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 547741 - DNA, 497 bp, Homo sapiens
  misc_feature: HIJSMM301CCTXX.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccca

SEQ ID NO: 547742 - DNA, 472 bp, Homo sapiens; identical to SEQ ID NO: 535898
  misc_feature: HIJSMM301BQDIX.15.8.A08.1.454.light.4.raw

SEQ ID NO: 547743 - DNA, 486 bp, Homo sapiens
  misc_feature: HIJSMM301EM9PG.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggccaaactgtccgtcctaggtcagccccg

SEQ ID NO: 547744 - DNA, 488 bp, Homo sapiens
  misc_feature: HIJSMM301BJOWL.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaacttttttaaattggtatcagcgggaaccagggaaagcccctaaactcctgatctatactgcatccaatttgcaaagtgggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccat

SEQ ID NO: 547745 - DNA, 479 bp, Homo sapiens
  misc_feature: HIJSMM301AGKQB.3.14.B03.1.454.light.4.raw
agacgcactccacgaccggtgctcgatttagtgtgagtagttccgcggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagcccagccagcaataagaactacttaggttggtagcagcagaatccaggacagcctcctaagctgctcatttactgggcatctacccgggaatccggggtccctgaccgattcagtggcggcgggtctgggacagatttcactctcaccatcagcagcctgcaggctgctgaagtggcagctcattactgtcagcaatattatagtcctcctggtgaagttttggccaggggaccaagctggagatcaaacgaactgtggctgcaccatct

SEQ ID NO: 547746 - DNA, 509 bp, Homo sapiens
  misc_feature: HIJSMM301BNNTT.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggcctgccccctcggtcactctgttccccg

SEQ ID NO: 547747 - DNA, 488 bp, Homo sapiens; identical to SEQ ID NO: 536861
  misc_feature: HIJSMM301EJ50G.12.88.H11.1.454.light.4.raw

SEQ ID NO: 547748 - DNA, 494 bp, Homo sapiens; identical to SEQ ID NO: 535828
  misc_feature: HIJSMM301CJU7Q.3.36.D03.1.454.light.4.raw

SEQ ID NO: 547749 - DNA, 496 bp, Homo sapiens
  misc_feature: HIJSMM301DYG8M.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcggggggaccgaagctggagatcaaccgaactgtggctgcaccatctgt

SEQ ID NO: 547750 - DNA, 515 bp, Homo sapiens; identical to SEQ ID NO: 539211
  misc_feature: HIJSMM301AFBZ6.22.28.C06.1.454.light.4.raw

SEQ ID NO: 547751 - DNA, 465 bp, Homo sapiens; identical to SEQ ID NO: 539935
  misc_feature: HIJSMM301DCMK4.3.20.B09.1.454.light.4.raw

SEQ ID NO: 547752 - DNA, 495 bp, Homo sapiens
  misc_feature: HIJSMM301CT384.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggtccgacgggacgaactaggacgatcaaacgaaactagtggcgtgcaccactctgtt

SEQ ID NO: 547753 - DNA, 497 bp, Homo sapiens; identical to SEQ ID NO: 535740
  misc_feature: HIJSMM301ETETS.3.71.G05.1.454.light.4.raw

SEQ ID NO: 547754 - DNA, 493 bp, Homo sapiens; identical to SEQ ID NO: 535745
  misc_feature: HIJSMM301AHJV2.47.78.H01.1.454.light.4.raw

SEQ ID NO: 547755 - DNA, 489 bp, Homo sapiens; identical to SEQ ID NO: 535139
  misc_feature: HIJSMM301BZ9VF.14.55.E11.1.454.light.4.raw

SEQ ID NO: 547756 - DNA, 485 bp, Homo sapiens; identical to SEQ ID NO: 534977
  misc_feature: HIJSMM301A6PT0.15.28.C06.1.454.light.4.raw

SEQ ID NO: 547757 - DNA, 482 bp, Homo sapiens; identical to SEQ ID NO: 535216
  misc_feature: HIJSMM301DWGL6.17.26.C04.1.454.light.4.raw

SEQ ID NO: 547758 - DNA, 444 bp, Homo sapiens; identical to SEQ ID NO: 535027
  misc_feature: HIJSMM301C82C6.8.73.G07.1.454.light.4.raw

SEQ ID NO: 547759 - DNA, 510 bp, Homo sapiens; identical to SEQ ID NO: 547100
  misc_feature: HIJSMM301D3CUA.48.23.C01.1.454.light.4.raw

SEQ ID NO: 547760 - DNA, 503 bp, Homo sapiens
  misc_feature: HIJSMM301DINDN.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttccgcc

SEQ ID NO: 547761 - DNA, 486 bp, Homo sapiens; identical to SEQ ID NO: 537428
  misc_feature: HIJSMM301APOUW.47.62.F07.1.454.light.4.raw

SEQ ID NO: 547762 - DNA, 489 bp, Homo sapiens; identical to SEQ ID NO: 540424
  misc_feature: HIJSMM301EXRCT.17.25.C03.1.454.light.4.raw

SEQ ID NO: 547763 - DNA, 513 bp, Homo sapiens; identical to SEQ ID NO: 545752
  misc_feature: HIJSMM301BBKGG.17.33.C11.1.454.light.4.raw

SEQ ID NO: 547764 - DNA, 495 bp, Homo sapiens; identical to SEQ ID NO: 535596
  misc_feature: HIJSMM301BFEOA.10.79.H02.1.454.light.4.raw

SEQ ID NO: 547765 - DNA, 500 bp, Homo sapiens; identical to SEQ ID NO: 545976
  misc_feature: HIJSMM301D2WQW.14.23.C01.1.454.light.4.raw

SEQ ID NO: 547766 - DNA, 490 bp, Homo sapiens; identical to SEQ ID NO: 541567
  misc_feature: HIJSMM301BTJYH.22.65.F10.1.454.light.4.raw

SEQ ID NO: 547767 - DNA, 484 bp, Homo sapiens; identical to SEQ ID NO: 535400
  misc_feature: HIJSMM301CTV07.46.26.C04.1.454.light.4.raw

SEQ ID NO: 547768 - DNA, 444 bp, Homo sapiens; identical to SEQ ID NO: 535411
  misc_feature: HIJSMM301B53FY.8.73.G07.1.454.light.4.raw

SEQ ID NO: 547769 - DNA, 480 bp, Homo sapiens
  misc_feature: HIJSMM301DVJ66.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcacatctgt

SEQ ID NO: 547770 - DNA, 489 bp, Homo sapiens; identical to SEQ ID NO: 546040
  misc_feature: HIJSMM301AFLF2.11.12.B01.1.454.light.4.raw

SEQ ID NO: 547771 - DNA, 521 bp, Homo sapiens
  misc_feature: HIJSMM301CJGGI.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctcgttcccaccctcctca

SEQ ID NO: 547772 - DNA, 493 bp, Homo sapiens
  misc_feature: HIJSMM301CRV9U.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactgtggctgcaccatctgtcttcat

SEQ ID NO: 547773 - DNA, 504 bp, Homo sapiens
  misc_feature: HIJSMM301AY3T2.22.65.F10.1.454.light.4.raw
  modified_base (423)..(423): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccnccgatccaccgttcggaccgaaggacacgacgtggaagtaacttaaacgacgtgtggctgaccaaccatctgttcttacta

SEQ ID NO: 547774 - DNA, 495 bp, Homo sapiens
  misc_feature: HIJSMM301EBCXM.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccaagctggagatcaaacgaactgtggctgcaccatctgt

SEQ ID NO: 547775 - DNA, 502 bp, Homo sapiens
  misc_feature: HIJSMM301EX3ES.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctacagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttccgccat

SEQ ID NO: 547776 - DNA, 441 bp, Homo sapiens; identical to SEQ ID NO: 534971
  misc_feature: HIJSMM301BV07O.11.3.A03.1.454.light.4.raw

SEQ ID NO: 547777 - DNA, 477 bp, Homo sapiens
  misc_feature: HIJSMM301EJUHP.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgcaacttactattgtcaacaggctaacagtttcccgctcaccttcggcgggggaccaaggtggagatcaaacgaactgtaggctgcacc

SEQ ID NO: 547778 - DNA, 515 bp, Homo sapiens
  misc_feature: HIJSMM301CQ5CR.51.30.C08.1.454.light.4.raw
cgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtgggcccaggtggggatgagggtgattactactgttactcaacagacattactactactcatagggtgttcggcggagggaccaagctgaccgtctaggtcagcccaaggctgccccctcggtcactctgttcccgcctcctctcg

SEQ ID NO: 547779 - DNA, 472 bp, Homo sapiens
  misc_feature: HIJSMM301B0VDD.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgactgtggctgcaccatctgtcttcatcttcccgccatctgagacacgcgag

SEQ ID NO: 547780 - DNA, 519 bp, Homo sapiens
  misc_feature: HIJSMM301CWB6Z.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 547781 - DNA, 444 bp, Homo sapiens; identical to SEQ ID NO: 535594
  misc_feature: HIJSMM301CITIZ.9.9.A09.1.454.light.4.raw

SEQ ID NO: 547782 - DNA, 513 bp, Homo sapiens
  misc_feature: HIJSMM301C2Y7W.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccagtcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagagatttttgttaaggggaaagtaatgaagttaa

SEQ ID NO: 547783 - DNA, 473 bp, Homo sapiens; identical to SEQ ID NO: 537887
  misc_feature: HIJSMM301BN01J.52.59.F04.1.454.light.4.raw

SEQ ID NO: 547784 - DNA, 491 bp, Homo sapiens
  misc_feature: HIJSMM301ARHB9.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacg

SEQ ID NO: 547785 - DNA, 504 bp, Homo sapiens
  misc_feature: HIJSMM301B9KUJ.43.71.G05.1.454.light.4.raw
tgtgagtagtcacgaccggtgctcgatttagtgtcgtcgcaagagagaggggcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggagcctgaagattttgcagtgtattactgtcagcagtatggtagctcacaggggacgttcggccaagggaccaaggtgg

SEQ ID NO: 547786 - DNA, 487 bp, Homo sapiens; identical to SEQ ID NO: 539440
  misc_feature: HIJSMM301B18ME.8.12.B01.1.454.light.4.raw

SEQ ID NO: 547787 - DNA, 481 bp, Homo sapiens
  misc_feature: HIJSMM301DHELR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtggtttcggcggagggaccaagctgaccgtcctaggtcagcccg

SEQ ID NO: 547788 - DNA, 497 bp, Homo sapiens
  misc_feature: HIJSMM301ANOTP.51.57.F02.1.454.light.4.raw
cgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtctttcggaactgcgaccaaggtcaccgtcctgggtcagcccaaggccaaccccactgtcact

SEQ ID NO: 547789 - DNA, 495 bp, Homo sapiens; identical to SEQ ID NO: 543094
  misc_feature: HIJSMM301C22DJ.22.57.F02.1.454.light.4.raw

SEQ ID NO: 547790 - DNA, 507 bp, Homo sapiens
  misc_feature: HIJSMM301DCHGM.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggtcgggacccagatgactgtcctcagtcagcccaaggctgccccctcggt

SEQ ID NO: 547791 - DNA, 486 bp, Homo sapiens
  misc_feature: HIJSMM301BTOZ5.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgaactgtggctgcaccat

SEQ ID NO: 547792 - DNA, 444 bp, Homo sapiens; identical to SEQ ID NO: 534993
  misc_feature: HIJSMM301A9UPI.5.9.A09.1.454.light.4.raw

SEQ ID NO: 547793 - DNA, 454 bp, Homo sapiens
  misc_feature: HIJSMM301B5JUN.48.60.F05.1.454.light.4.raw
agtatacatacacgaccggtgctcgatttagtacgtcatcagggaaagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgttcccgccctcctctatgtatact

SEQ ID NO: 547794 - DNA, 447 bp, Homo sapiens; identical to SEQ ID NO: 535020
  misc_feature: HIJSMM301CUULK.18.9.A09.1.454.light.4.raw

SEQ ID NO: 547795 - DNA, 496 bp, Homo sapiens; identical to SEQ ID NO: 535109
  misc_feature: HIJSMM301CDY9J.16.78.H01.1.454.light.4.raw

SEQ ID NO: 547796 - DNA, 493 bp, Homo sapiens; identical to SEQ ID NO: 541489
  misc_feature: HIJSMM301C3MJR.12.23.C01.1.454.light.4.raw

SEQ ID NO: 547797 - DNA, 494 bp, Homo sapiens; identical to SEQ ID NO: 534992
  misc_feature: HIJSMM301AHJYB.9.1.A01.1.454.light.4.raw

SEQ ID NO: 547798 - DNA, 503 bp, Homo sapiens
  misc_feature: HIJSMM301EQV1G.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatgacaatctgagcggttgggtgttcggcggagggaccaaactgaccgtcctaggtcagcccaa

SEQ ID NO: 547799 - DNA, 489 bp, Homo sapiens; identical to SEQ ID NO: 535091
  misc_feature: HIJSMM301EKOLN.47.36.D03.1.454.light.4.raw

SEQ ID NO: 547800 - DNA, 485 bp, Homo sapiens; identical to SEQ ID NO: 544818
  misc_feature: HIJSMM301ASPCA.13.36.D03.1.454.light.4.raw

SEQ ID NO: 547801 - DNA, 443 bp, Homo sapiens
  misc_feature: HIJSMM301EGFXB.2.76.G10.1.454.light.4.raw
acgctcgacacacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcctaccctcctctgtcgagcgt

SEQ ID NO: 547802 - DNA, 492 bp, Homo sapiens; identical to SEQ ID NO: 541409
  misc_feature: HIJSMM301CRPGJ.48.35.D02.1.454.light.4.raw

SEQ ID NO: 547803 - DNA, 472 bp, Homo sapiens
  misc_feature: HIJSMM301DMURM.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgactggagattaaacgaa

SEQ ID NO: 547804 - DNA, 495 bp, Homo sapiens
  misc_feature: HIJSMM301B014E.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 547805 - DNA, 492 bp, Homo sapiens
  misc_feature: HIJSMM301DSEN5.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 547806 - DNA, 507 bp, Homo sapiens
  misc_feature: HIJSMM301D82VU.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagccacgaccgacctaccactacgtcact

SEQ ID NO: 547807 - DNA, 488 bp, Homo sapiens; identical to SEQ ID NO: 536861
  misc_feature: HIJSMM301CELQR.12.88.H11.1.454.light.4.raw

SEQ ID NO: 547808 - DNA, 483 bp, Homo sapiens
  misc_feature: HIJSMM301CCZR0.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaagtggaaatacaaacgaactgtggctgcacca

SEQ ID NO: 547809 - DNA, 490 bp, Homo sapiens
  misc_feature: HIJSMM301AROZN.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgccacgggaccgacggtcggagtgtcaagcgaacgtcgtggcgtgcgaccact

SEQ ID NO: 547810 - DNA, 489 bp, Homo sapiens
  misc_feature: HIJSMM301CMB1M.48.37.D04.1.454.light.4.raw
agtatacatacacgaccggtgctcgatttagtagcatactgttgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaaggctgaccgtcctaggtcacg

SEQ ID NO: 547811 - DNA, 507 bp, Homo sapiens
  misc_feature: HIJSMM301BQVH6.48.3.A03.1.454.light.4.raw
agtatacatacacgaccggtgctcgatttagagagcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgactatctctgggctccaggctgaagatcaggctgattattactgctgttcattttctaagttcctttttgttctttcggaactgggaccgaggtcaccgtcctaggtcagcccaaggccaaccccactgtcta

SEQ ID NO: 547812 - DNA, 507 bp, Homo sapiens; identical to SEQ ID NO: 535641
  misc_feature: HIJSMM301CYM12.10.88.H11.1.454.light.4.raw

SEQ ID NO: 547813 - DNA, 497 bp, Homo sapiens; identical to SEQ ID NO: 534982
  misc_feature: HIJSMM301CT27N.26.80.H03.1.454.light.4.raw

SEQ ID NO: 547814 - DNA, 483 bp, Homo sapiens; identical to SEQ ID NO: 544010
  misc_feature: HIJSMM301B9AVS.19.5.A05.1.454.light.4.raw

SEQ ID NO: 547815 - DNA, 503 bp, Homo sapiens; identical to SEQ ID NO: 538884
  misc_feature: HIJSMM301BER4V.27.78.H01.1.454.light.4.raw

SEQ ID NO: 547816 - DNA, 490 bp, Homo sapiens; identical to SEQ ID NO: 537951
  misc_feature: HIJSMM301DR4OG.19.57.F02.1.454.light.4.raw

SEQ ID NO: 547817 - DNA, 419 bp, Homo sapiens; identical to SEQ ID NO: 543165
  misc_feature: HIJSMM301BX95I.18.78.H01.1.454.light.4.raw

SEQ ID NO: 547818 - DNA, 506 bp, Homo sapiens; identical to SEQ ID NO: 541085
  misc_feature: HIJSMM301AEGDF.16.46.E02.1.454.light.4.raw

SEQ ID NO: 547819 - DNA, 495 bp, Homo sapiens; identical to SEQ ID NO: 535007
  misc_feature: HIJSMM301EUS75.22.5.A05.1.454.light.4.raw

SEQ ID NO: 547820 - DNA, 520 bp, Homo sapiens
  misc_feature: HIJSMM301A6XQT.7.86.H09.1.454.light.4.raw
  modified_base (505)..(505): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctaggccaggctccccgacctcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctntcttcatcttccccg

SEQ ID NO: 547821 - DNA, 476 bp, Homo sapiens
  misc_feature: HIJSMM301CEAPU.43.51.E07.1.454.light.4.raw
tgtgagtagtcacgaccggtgctcgatttagcatactctacaacacacaaagggggcttcagctgtgggcacaagaggcagcactcaggacaatctccagcatggcctggtctcctctcctcctcactctcctcgctcactgcacagggtcctgggcccagtctgtattgacgcagccgccctcagtgtctggggccccagggcagagggtcaccatctcctgcactgggagcgcctccaacattgggacaggttatgatgtacactggtaccagcaccttccaggagcagcccccaaactcgtcatctatgctgacaacagtcggccctcaggggtccctgaccgattctctggctccaagtctggcacctcagcctccctggacatcactgggctccaggctgaggatgaggctgactattactgccagtgctatgacagcgacctgagcggttcgatcttcggcggagggacg

SEQ ID NO: 547822 - DNA, 484 bp, Homo sapiens; identical to SEQ ID NO: 535441
  misc_feature: HIJSMM301A3COF.26.60.F05.1.454.light.4.raw

SEQ ID NO: 547823 - DNA, 494 bp, Homo sapiens; identical to SEQ ID NO: 534992
  misc_feature: HIJSMM301A4AMD.9.1.A01.1.454.light.4.raw

SEQ ID NO: 547824 - DNA, 473 bp, Homo sapiens
  misc_feature: HIJSMM301CG452.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacattcaaacgaa

SEQ ID NO: 547825 - DNA, 483 bp, Homo sapiens; identical to SEQ ID NO: 545669
  misc_feature: HIJSMM301BFNZT.13.8.A08.1.454.light.4.raw

SEQ ID NO: 547826 - DNA, 465 bp, Homo sapiens
  misc_feature: HIJSMM301EM3GW.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagatagcgctgccccgctcagtttcggcggagggaccaaggtggagatacg

SEQ ID NO: 547827 - DNA, 484 bp, Homo sapiens; identical to SEQ ID NO: 536395
  misc_feature: HIJSMM301EBWQD.46.35.D02.1.454.light.4.raw

SEQ ID NO: 547828 - DNA, 507 bp, Homo sapiens; identical to SEQ ID NO: 538063
  misc_feature: HIJSMM301AG1Z4.47.85.H08.1.454.light.4.raw

SEQ ID NO: 547829 - DNA, 488 bp, Homo sapiens; identical to SEQ ID NO: 539884
  misc_feature: HIJSMM301ERLAV.7.85.H08.1.454.light.4.raw

SEQ ID NO: 547830 - DNA, 473 bp, Homo sapiens
  misc_feature: HIJSMM301C2W3B.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtaga

SEQ ID NO: 547831 - DNA, 503 bp, Homo sapiens
  misc_feature: HIJSMM301CK3XM.4.57.F02.1.454.light.4.raw
  modified_base (392)..(392): a, c, t, g, unknown or other
  modified_base (500)..(500): a, c, t, g, unknown or other
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgnggccgactattactgtcaggtgtgggatagtagtggtgatcatccataccgtcttcggaactggaccaaggtctccgtcctacgcagcccaggccaactccactgtcnctt

SEQ ID NO: 547832 - DNA, 493 bp, Homo sapiens; identical to SEQ ID NO: 547468
  misc_feature: HIJSMM301BPH35.11.81.H04.1.454.light.4.raw

SEQ ID NO: 547833 - DNA, 492 bp, Homo sapiens; identical to SEQ ID NO: 534967
  misc_feature: HIJSMM301BRCGR.47.64.F09.1.454.light.4.raw

SEQ ID NO: 547834 - DNA, 476 bp, Homo sapiens
  misc_feature: HIJSMM301BPCJ2.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcacc

SEQ ID NO: 547835 - DNA, 521 bp, Homo sapiens; identical to SEQ ID NO: 538715
  misc_feature: HIJSMM301BDA9V.27.23.C01.1.454.light.4.raw

SEQ ID NO: 547836 - DNA, 505 bp, Homo sapiens; identical to SEQ ID NO: 539292
  misc_feature: HIJSMM301EKEIQ.19.85.H08.1.454.light.4.raw

SEQ ID NO: 547837 - DNA, 483 bp, Homo sapiens
  misc_feature: HIJSMM301EN6VP.48.40.D07.1.454.light.4.raw
agtatacatacacgaccggtgctcgatttagtgatagagcgtaacaacagagggggatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccaagggaccaaggtggagatcaaacg

SEQ ID NO: 547838 - DNA, 483 bp, Homo sapiens
  misc_feature: HIJSMM301BZ670.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 547839 - DNA, 486 bp, Homo sapiens; identical to SEQ ID NO: 535290
  misc_feature: HIJSMM301DFZ6A.3.12.B01.1.454.light.4.raw

SEQ ID NO: 547840 - DNA, 484 bp, Homo sapiens; identical to SEQ ID NO: 536393
  misc_feature: HIJSMM301E10PX.4.41.D08.1.454.light.4.raw

SEQ ID NO: 547841 - DNA, 485 bp, Homo sapiens
  misc_feature: HIJSMM301ARGUJ.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaaggggacacgactggagattaaacgaactgtggctgcaccat

SEQ ID NO: 547842 - DNA, 494 bp, Homo sapiens; identical to SEQ ID NO: 534992
  misc_feature: HIJSMM301BI3FJ.9.1.A01.1.454.light.4.raw

SEQ ID NO: 547843 - DNA, 508 bp, Homo sapiens
  misc_feature: HIJSMM301B1VEH.52.46.E02.1.454.light.4.raw
cgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgcccctcggtcta

SEQ ID NO: 547844 - DNA, 496 bp, Homo sapiens
  misc_feature: HIJSMM301AG9UL.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttcatt

SEQ ID NO: 547845 - DNA, 480 bp, Homo sapiens
  misc_feature: HIJSMM301B2XGY.49.51.E07.1.454.light.4.raw
agtcgagagacacgaccggtgctcgatttagcatactctacaacacacaaaggggagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttaccgctcactttcggcggagggaccaaggtggagatcagacgaactgtggctgcaccat

SEQ ID NO: 547846 - DNA, 494 bp, Homo sapiens; identical to SEQ ID NO: 539894
  misc_feature: HIJSMM301C6U37.16.53.E09.1.454.light.4.raw

SEQ ID NO: 547847 - DNA, 497 bp, Homo sapiens
  misc_feature: HIJSMM301BPW2Q.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctcctcagacgttcggccaagggaccaaggtggaaatcaaacgaactgtggctgcacc

SEQ ID NO: 547848 - DNA, 480 bp, Homo sapiens
  misc_feature: HIJSMM301EKKGF.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtcctaggt

SEQ ID NO: 547849 - DNA, 497 bp, Homo sapiens
  misc_feature: HIJSMM301D97QG.52.28.C06.1.454.light.4.raw
cgcagtacgacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 547850 - DNA, 408 bp, Homo sapiens
  misc_feature: HIJSMM301BM7C0.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggttcagtggcagtggatcaggcacagattttacactgaaaatcagcagagtggaggctgaggatgttggggtttattactgcatgcaagctctacaaactccgctcactttcggcggagggaccaaggtggagatcaaacgaactgtggctgcaccatctgtcttcatcttcccgccatctgaactactcaca

SEQ ID NO: 547851 - DNA, 476 bp, Homo sapiens
  misc_feature: HIJSMM301EQX5N.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 547852 - DNA, 491 bp, Homo sapiens
  misc_feature: HIJSMM301DPNSN.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgtcatgcaagcaacacactggccgtacacttttggccaggggaccaagctggagatcaatcgaactgt

SEQ ID NO: 547853 - DNA, 509 bp, Homo sapiens
  misc_feature: HIJSMM301C7ADC.48.14.B03.1.454.light.4.raw
  modified_base (492)..(492): a, c, t, g, unknown or other
  modified_base (494)..(494): a, c, t, g, unknown or other
  modified_base (499)..(499): a, c, t, g, unknown or other
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccgagacagattcagcggcagtgggtcagacactgacttcacactgagaatcagcagggttgaggctgaggatgttggcacttattactgcatgcaaggctcacactggcctccgtggacgttcgcgaggaccgggacggaagtaaaagaaactagtagtgngnccacnctgtctctat

SEQ ID NO: 547854 - DNA, 499 bp, Homo sapiens
  misc_feature: HIJSMM301ECEJ2.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcgccaaggacaggtggaaatcagacgaactgtggctgcaccat

SEQ ID NO: 547855 - DNA, 496 bp, Homo sapiens
  misc_feature: HIJSMM301ECN3R.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagtagtctgcaacctgaagatttgtcaacttaactactgtcaacagagttactagtaaccccctccacttcggtcggagggaccgaacggcggagatcagacgaactgtggctgcaccactctgtcttctat

SEQ ID NO: 547856 - DNA, 500 bp, Homo sapiens; identical to SEQ ID NO: 544063
  misc_feature: HIJSMM301CNT5B.12.18.B07.1.454.light.4.raw

SEQ ID NO: 547857 - DNA, 522 bp, Homo sapiens; identical to SEQ ID NO: 539966
  misc_feature: HIJSMM301BHBWA.27.23.C01.1.454.light.4.raw

SEQ ID NO: 547858 - DNA, 502 bp, Homo sapiens
  misc_feature: HIJSMM301A7TD9.49.45.E01.1.454.light.4.raw
agtcgagagacacgaccggtgctcgatttagtgagtcagtaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattgtacttatgtcttcggaactgcgaccaaggtccaccgtcctgggtcagcccaacggccaaccccacctcgtcactctcg

SEQ ID NO: 547859 - DNA, 499 bp, Homo sapiens
  misc_feature: HIJSMM301EOZUA.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaaactgtggctgcaccat

SEQ ID NO: 547860 - DNA, 505 bp, Homo sapiens
  misc_feature: HIJSMM301COL6G.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataattgtttttacccgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtt

SEQ ID NO: 547861 - DNA, 504 bp, Homo sapiens
  misc_feature: HIJSMM301CQFX6.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccacctcctccgtgt

SEQ ID NO: 547862 - DNA, 494 bp, Homo sapiens; identical to SEQ ID NO: 535497
  misc_feature: HIJSMM301CO5GY.43.72.G06.1.454.light.4.raw

SEQ ID NO: 547863 - DNA, 447 bp, Homo sapiens; identical to SEQ ID NO: 535020
  misc_feature: HIJSMM301BRA86.18.9.A09.1.454.light.4.raw

SEQ ID NO: 547864 - DNA, 501 bp, Homo sapiens
  misc_feature: HIJSMM301B26D0.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtcttcatcttcccg

SEQ ID NO: 547865 - DNA, 494 bp, Homo sapiens
  misc_feature: HIJSMM301CXP9N.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccagggaccaagctggagatcaaacgaactgtggctgcaccatctgt

SEQ ID NO: 547866 - DNA, 520 bp, Homo sapiens
  misc_feature: HIJSMM301AFSSU.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggacgacacgtagaaatagagacgaacgtacgtggcgtcgtcgaccactaccttcgtctttcctactcttccccgt

SEQ ID NO: 547867 - DNA, 506 bp, Homo sapiens
  misc_feature: HIJSMM301A1FRX.3.4.A04.1.454.light.4.raw
  modified_base (429)..(429): a, c, t, g, unknown or other
  modified_base (491)..(491): a, c, t, g, unknown or other
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacanactggcctccgacgttcggccacgggacccaaggtggaaagtcaaacgaacctgtggctgcnccaatctgtcttcta

SEQ ID NO: 547868 - DNA, 504 bp, Homo sapiens; identical to SEQ ID NO: 539690
  misc_feature: HIJSMM301CO6VC.47.65.F10.1.454.light.4.raw

SEQ ID NO: 547869 - DNA, 513 bp, Homo sapiens; identical to SEQ ID NO: 540462
  misc_feature: HIJSMM301EED81.47.85.H08.1.454.light.4.raw

SEQ ID NO: 547870 - DNA, 444 bp, Homo sapiens
  misc_feature: HIJSMM301CPTN5.5.9.A09.1.454.light.4.raw
atcagacacgcacgaccggtgctcgatttagcgagacgcgcagggtcctgggcccagtctgtggtgacgcagccgccctctgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtgtctgat

SEQ ID NO: 547871 - DNA, 521 bp, Homo sapiens; identical to SEQ ID NO: 536990
  misc_feature: HIJSMM301BAQ4I.27.23.C01.1.454.light.4.raw
  modified_base (517)..(517): a, c, t, g, unknown or other

SEQ ID NO: 547872 - DNA, 486 bp, Homo sapiens
  misc_feature: HIJSMM301EC7S6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcgagatcagacgaactgtggctgcaccatctgtcttc

SEQ ID NO: 547873 - DNA, 508 bp, Homo sapiens
  misc_feature: HIJSMM301BIKNM.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgtttgggtgttcggcggagggaccaagctgaccgttcg

SEQ ID NO: 547874 - DNA, 485 bp, Homo sapiens
  misc_feature: HIJSMM301AIFPB.43.60.F05.1.454.light.4.raw
  modified_base (441)..(441): a, c, t, g, unknown or other
  modified_base (456)..(456): a, c, t, g, unknown or other
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtccgnggaccgacggacggngtgtcagcgaacgtagtggcgtgcaccat

SEQ ID NO: 547875 - DNA, 444 bp, Homo sapiens; identical to SEQ ID NO: 534993
  misc_feature: HIJSMM301CUBW2.5.9.A09.1.454.light.4.raw

SEQ ID NO: 547876 - DNA, 511 bp, Homo sapiens; identical to SEQ ID NO: 535945
  misc_feature: HIJSMM301CKOXT.43.23.C01.1.454.light.4.raw

SEQ ID NO: 547877 - DNA, 488 bp, Homo sapiens; identical to SEQ ID NO: 538291
  misc_feature: HIJSMM301A6VWV.19.71.G05.1.454.light.4.raw

SEQ ID NO: 547878 - DNA, 498 bp, Homo sapiens
  misc_feature: HIJSMM301CK8FL.48.57.F02.1.454.light.4.raw
agtatacatacacgaccggtgctcgatttagctcgatatagttgggtttggggacaacaggcaggcaggggcagcaagatggtgttgcagacccaggtcttcatttctctgttgctctggatctctggtgcctacggggacgtcgtgatgacccagtctccagactccctggcagtgtctctgggcggagggccaccgatacgaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 547879 - DNA, 493 bp, Homo sapiens
  misc_feature: HIJSMM301DUM8D.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactctttctcttcggaactgggaccacggtcaccgtcctaggtcagcccaaggccaacccactgtcactctgttcccaccctcctcgtatct

SEQ ID NO: 547880 - DNA, 434 bp, Homo sapiens; identical to SEQ ID NO: 535153
  misc_feature: HIJSMM301APLWO.18.5.A05.1.454.light.4.raw

SEQ ID NO: 547881 - DNA, 447 bp, Homo sapiens; identical to SEQ ID NO: 535020
  misc_feature: HIJSMM301DPUPJ.18.9.A09.1.454.light.4.raw

SEQ ID NO: 547882 - DNA, 490 bp, Homo sapiens
  misc_feature: HIJSMM301DJX8W.40.38.D05.1.454.light.4.raw
tctagcgactcacgaccggtgctcgatttagtatctgatagttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcggaccgagagtggagtgtcaacgaactagt

SEQ ID NO: 547883 - DNA, 384 bp, Homo sapiens
  misc_feature: HIJSMM301BMJLD.48.35.D02.1.454.light.4.raw
agtatacatacacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 547884 - DNA, 512 bp, Homo sapiens
  misc_feature: HIJSMM301CQY50.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctggctcgagtctgaggacgaggctgattacttctgttgctcttgggcaactactgtcgtttgggtgttcggcggagggaccaagttgaccgtcctaggtcagccaaggctgccccctcggtcactctgttccccg

SEQ ID NO: 547885 - DNA, 477 bp, Homo sapiens; identical to SEQ ID NO: 535506
  misc_feature: HIJSMM301ATNZM.7.67.G01.1.454.light.4.raw

SEQ ID NO: 547886 - DNA, 487 bp, Homo sapiens
  misc_feature: HIJSMM301AN5FS.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactagtggctgcaccta

SEQ ID NO: 547887 - DNA, 495 bp, Homo sapiens; identical to SEQ ID NO: 535007
  misc_feature: HIJSMM301BLN0J.22.5.A05.1.454.light.4.raw

SEQ ID NO: 547888 - DNA, 486 bp, Homo sapiens; identical to SEQ ID NO: 535043
  misc_feature: HIJSMM301ESS6Z.46.35.D02.1.454.light.4.raw

SEQ ID NO: 547889 - DNA, 485 bp, Homo sapiens; identical to SEQ ID NO: 536576
  misc_feature: HIJSMM301DMB49.46.35.D02.1.454.light.4.raw

SEQ ID NO: 547890 - DNA, 494 bp, Homo sapiens; identical to SEQ ID NO: 534992
  misc_feature: HIJSMM301DMXD6.9.1.A01.1.454.light.4.raw

SEQ ID NO: 547891 - DNA, 466 bp, Homo sapiens; identical to SEQ ID NO: 541765
  misc_feature: HIJSMM301AYPY7.11.70.G04.1.454.light.4.raw

SEQ ID NO: 547892 - DNA, 488 bp, Homo sapiens; identical to SEQ ID NO: 537673
  misc_feature: HIJSMM301CYP4Y.12.31.C09.1.454.light.4.raw

SEQ ID NO: 547893 - DNA, 487 bp, Homo sapiens; identical to SEQ ID NO: 536163
  misc_feature: HIJSMM301A0CHV.5.48.E04.1.454.light.4.raw

SEQ ID NO: 547894 - DNA, 482 bp, Homo sapiens
  misc_feature: HIJSMM301C75IE.43.4.A04.1.454.light.4.raw
tgtgagtagtcacgaccggtgctcgatttagagtagtgatcaggggagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacttcggccaagggaccaaggtggacatcaacgaactgtggctgcacc

SEQ ID NO: 547895 - DNA, 496 bp, Homo sapiens
  misc_feature: HIJSMM301EHS30.9.1.A01.1.454.light.4.raw
tgatacgtctcacgaccggtgctcgatttagacgtctcatcagggggagctgctcagttaggacccagagggaaccgatggaaaccccacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 547896 - DNA, 472 bp, Homo sapiens; identical to SEQ ID NO: 536302
  misc_feature: HIJSMM301AK6D5.18.76.G10.1.454.light.4.raw

SEQ ID NO: 547897 - DNA, 444 bp, Homo sapiens; identical to SEQ ID NO: 535192
  misc_feature: HIJSMM301CWZZM.5.9.A09.1.454.light.4.raw

SEQ ID NO: 547898 - DNA, 515 bp, Homo sapiens
  misc_feature: HIJSMM301CAG8J.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccctcctctctctcg

SEQ ID NO: 547899 - DNA, 445 bp, Homo sapiens; identical to SEQ ID NO: 537719
  misc_feature: HIJSMM301CFYQL.47.85.H08.1.454.light.4.raw

SEQ ID NO: 547900 - DNA, 509 bp, Homo sapiens
  misc_feature: HIJSMM301AMVEB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccactgtgatcttcggcggggggaccgaagctgaccgtcctaggtcagcccaaggctgccccccg

SEQ ID NO: 547901 - DNA, 508 bp, Homo sapiens; identical to SEQ ID NO: 537871
  misc_feature: HIJSMM301ES8TF.8.33.C11.1.454.light.4.raw

SEQ ID NO: 547902 - DNA, 505 bp, Homo sapiens; identical to SEQ ID NO: 535503
  misc_feature: HIJSMM301ETV08.8.28.C06.1.454.light.4.raw

SEQ ID NO: 547903 - DNA, 478 bp, Homo sapiens
  misc_feature: HIJSMM301A2SBG.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaagaactgtgg

SEQ ID NO: 547904 - DNA, 506 bp, Homo sapiens
  misc_feature: HIJSMM301EIFRX.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctaggcctctgagtggttttggccaggggaccaagctggacatcaaaacgaaactgtggctgcaccatctgtcttcatcttcccgcca

SEQ ID NO: 547905 - DNA, 515 bp, Homo sapiens
  misc_feature: HIJSMM301EZ67V.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttccccaccctcctcga

SEQ ID NO: 547906 - DNA, 513 bp, Homo sapiens
  misc_feature: HIJSMM301BPAVG.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaaggaccgaacggtggaagtacgaaacgaactagtggcgtgcgaccactctgtcttctatcttcccgtcccact

SEQ ID NO: 547907 - DNA, 494 bp, Homo sapiens; identical to SEQ ID NO: 534994
  misc_feature: HIJSMM301CLPGE.27.78.H01.1.454.light.4.raw

SEQ ID NO: 547908 - DNA, 494 bp, Homo sapiens; identical to SEQ ID NO: 534992
  misc_feature: HIJSMM301BNO83.9.1.A01.1.454.light.4.raw

SEQ ID NO: 547909 - DNA, 484 bp, Homo sapiens
  misc_feature: HIJSMM301B3QST.40.15.B04.1.454.light.4.raw
tctagcgactcacgaccggtgctcgatttagacagtatatatccgcggggtccaaacagagcttcagcaagcatagtgggaatctgcaccatgccctgggctctgctcctcctgaccctcctcactcactctgcagtgtcagtggtccaggcagggctgactcagccacctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcggtattcggcgcagggaccgaagctgaccgtcctaggtcacg

SEQ ID NO: 547910 - DNA, 496 bp, Homo sapiens; identical to SEQ ID NO: 535109
  misc_feature: HIJSMM301AMN2I.16.78.H01.1.454.light.4.raw

SEQ ID NO: 547911 - DNA, 503 bp, Homo sapiens
  misc_feature: HIJSMM301B5TC6.7.31.C09.1.454.light.4.raw
cgtgtctctacacgaccggtgctcgatttagacgtctcatcaaggaaggaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 547912 - DNA, 487 bp, Homo sapiens; identical to SEQ ID NO: 535583
  misc_feature: HIJSMM301D4U56.22.73.G07.1.454.light.4.raw

SEQ ID NO: 547913 - DNA, 491 bp, Homo sapiens; identical to SEQ ID NO: 536211
  misc_feature: HIJSMM301DGCQZ.16.53.E09.1.454.light.4.raw

SEQ ID NO: 547914 - DNA, 470 bp, Homo sapiens; identical to SEQ ID NO: 542328
  misc_feature: HIJSMM301AS6NU.18.76.G10.1.454.light.4.raw

SEQ ID NO: 547915 - DNA, 504 bp, Homo sapiens
  misc_feature: HIJSMM301DGDCD.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccatgtca

SEQ ID NO: 547916 - DNA, 508 bp, Homo sapiens
  misc_feature: HIJSMM301ETAN8.16.66.F11.1.454.light.4.raw
tgtactactccacgaccggtgctcgatttagtcacgcgagaagggtgagaagtagtggagcatcccactatggcctgggctccactacttctcaccctcctcgctcactgcacaggttcttgggccaatttctacttactcagcccactctgtgtcggagtctccgggaagacggtaaccatctcctgcaccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccaccctcctcgagtagtaca

SEQ ID NO: 547917 - DNA, 490 bp, Homo sapiens; identical to SEQ ID NO: 541567
  misc_feature: HIJSMM301B31O3.22.65.F10.1.454.light.4.raw

SEQ ID NO: 547918 - DNA, 493 bp, Homo sapiens
  misc_feature: HIJSMM301EBYAP.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaaactgt

SEQ ID NO: 547919 - DNA, 510 bp, Homo sapiens
  misc_feature: HIJSMM301EIWVO.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaaacgaactagtggctgcaccatctgtctt

SEQ ID NO: 547920 - DNA, 507 bp, Homo sapiens
  misc_feature: HIJSMM301BPH20.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctcgccccctcggtcactctgttcccg

SEQ ID NO: 547921 - DNA, 486 bp, Homo sapiens; identical to SEQ ID NO: 538674
  misc_feature: HIJSMM301EST1W.47.38.D05.1.454.light.4.raw

SEQ ID NO: 547922 - DNA, 486 bp, Homo sapiens
  misc_feature: HIJSMM301BARAA.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgaactggaggattaaacgaaactgtggctgcacca

SEQ ID NO: 547923 - DNA, 497 bp, Homo sapiens
  misc_feature: HIJSMM301DGG2D.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcaagaaatctggccagcctcccaggctcctcatctatggtgaatccaacagggccactggcatcccagacaggttcagtggcaggtgggtctgggacagacttcactctcaccatcagcagactggagcctgaggtattttgcagtgtattactgtcagcagtatcataggtcaaacaccttcggccaagggacacgactggagattaaaggaactgtggctgcaccatctgtcttcatcttccccg

SEQ ID NO: 547924 - DNA, 485 bp, Homo sapiens; identical to SEQ ID NO: 538954
  misc_feature: HIJSMM301DL6HT.3.55.E11.1.454.light.4.raw

SEQ ID NO: 547925 - DNA, 502 bp, Homo sapiens; identical to SEQ ID NO: 547312
  misc_feature: HIJSMM301AWC5P.14.57.F02.1.454.light.4.raw

SEQ ID NO: 547926 - DNA, 486 bp, Homo sapiens; identical to SEQ ID NO: 535043
  misc_feature: HIJSMM301ED6WI.46.35.D02.1.454.light.4.raw

SEQ ID NO: 547927 - DNA, 498 bp, Homo sapiens; identical to SEQ ID NO: 537020
  misc_feature: HIJSMM301ET8ZZ.26.26.C04.1.454.light.4.raw

SEQ ID NO: 547928 - DNA, 505 bp, Homo sapiens
  misc_feature: HIJSMM301BYHZM.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccaaccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctaaagcctggagattttgtagtttattactgtcagcagtatagcagctggcctcccactttcggcggagggaccaaggtggagatccaacgaactgtggctgcaccatctgtcttcatcttcccgcc

SEQ ID NO: 547929 - DNA, 486 bp, Homo sapiens; identical to SEQ ID NO: 535290
  misc_feature: HIJSMM301BN92H.3.12.B01.1.454.light.4.raw

SEQ ID NO: 547930 - DNA, 496 bp, Homo sapiens
  misc_feature: HIJSMM301DKOIU.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgaggaggccaccaagtcaactgcgaagtccagccagagtgttttatacaggtccgacaatagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttcccg

SEQ ID NO: 547931 - DNA, 485 bp, Homo sapiens
  misc_feature: HIJSMM301D2UP0.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaacgaactgtggctgcaccat

SEQ ID NO: 547932 - DNA, 512 bp, Homo sapiens
  misc_feature: HIJSMM301A7MOA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccta

SEQ ID NO: 547933 - DNA, 529 bp, Homo sapiens
  misc_feature: HIJSMM301D7SO0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaacgaaacctagtgggctggcaccactactgttctttattcttcccgtcccactcctg

SEQ ID NO: 547934 - DNA, 490 bp, Homo sapiens
  misc_feature: HIJSMM301EHQN2.16.68.G02.1.454.light.4.raw
  modified_base (459)..(459): a, c, t, g, unknown or other
  modified_base (480)..(480): a, c, t, g, unknown or other
tgtactactccacgaccggtgctcgatttagtcgatagtgaagggaaagggggagtcaggacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatattatgagacttctactttagaaagtggggtcccatcaaggttcagcggcagtggatctgggacagaattcactctcactatcaccagcctgcaacctgatgattttgcaacttattactgccaacagtatcatcatcattgtaattcggtggagggaccaaggtgaggtnaaacgaactgtggctgcacanctgtcttcat

SEQ ID NO: 547935 - DNA, 471 bp, Homo sapiens; identical to SEQ ID NO: 540579
  misc_feature: HIJSMM301EB4BJ.3.82.H05.1.454.light.4.raw

SEQ ID NO: 547936 - DNA, 465 bp, Homo sapiens
  misc_feature: HIJSMM301CK1T7.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtggctgcaccatctgtcttcatcttcccgccatctgaagtatagtct

SEQ ID NO: 547937 - DNA, 509 bp, Homo sapiens
  misc_feature: HIJSMM301DXVYC.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcgcggtaggaccgaaataagaggtacgaaacgaacgtacgttggcgtcgcaccaatctgtcttc

SEQ ID NO: 547938 - DNA, 485 bp, Homo sapiens; identical to SEQ ID NO: 539951
  misc_feature: HIJSMM301C0TZW.4.26.C04.1.454.light.4.raw

SEQ ID NO: 547939 - DNA, 520 bp, Homo sapiens; identical to SEQ ID NO: 539176
  misc_feature: HIJSMM301ELVXR.27.23.C01.1.454.light.4.raw

SEQ ID NO: 547940 - DNA, 482 bp, Homo sapiens
  misc_feature: HIJSMM301DUBQ1.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgtcttttcggcggagggaccaagctgaccgtcctacgtcagcccaaggctgccccctc

SEQ ID NO: 547941 - DNA, 496 bp, Homo sapiens; identical to SEQ ID NO: 538394
  misc_feature: HIJSMM301EY4S2.22.86.H09.1.454.light.4.raw

SEQ ID NO: 547942 - DNA, 479 bp, Homo sapiens; identical to SEQ ID NO: 541538
  misc_feature: HIJSMM301CJKSU.48.51.E07.1.454.light.4.raw

SEQ ID NO: 547943 - DNA, 500 bp, Homo sapiens; identical to SEQ ID NO: 535310
  misc_feature: HIJSMM301ATYRY.47.66.F11.1.454.light.4.raw

SEQ ID NO: 547944 - DNA, 498 bp, Homo sapiens
  misc_feature: HIJSMM301EV3GV.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 547945 - DNA, 492 bp, Homo sapiens
  misc_feature: HIJSMM301AEMSY.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtaggaggatcaaacgaaactgtggctgcaccat

SEQ ID NO: 547946 - DNA, 482 bp, Homo sapiens
  misc_feature: HIJSMM301CKQU5.48.19.B08.1.454.light.4.raw
  modified_base (437)..(437): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctaacncttgggtgttcggcggagggaccaagctgaccgtcctaggtcacg

SEQ ID NO: 547947 - DNA, 485 bp, Homo sapiens
  misc_feature: HIJSMM301EXDS2.4.19.B08.1.454.light.4.raw
agcactgtagcacgaccggtgctcgatttagtgagtcagtaaggggggagtcagactcagtcaggacacagcatggacatgagggtccccgctcagctcctggggctcctgctgctctggctcccaggagccgattgtggacagtccaagttgacccagtctccctcaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataatagttattggacgttcggccaggggaccaaggtggaattcaaacgaaactgtggctgcaccatctgtctt

SEQ ID NO: 547948 - DNA, 494 bp, Homo sapiens
  misc_feature: HIJSMM301B09MY.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccagacaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccat

SEQ ID NO: 547949 - DNA, 441 bp, Homo sapiens; identical to SEQ ID NO: 535074
  misc_feature: HIJSMM301AETK6.11.3.A03.1.454.light.4.raw

SEQ ID NO: 547950 - DNA, 457 bp, Homo sapiens; identical to SEQ ID NO: 539745
  misc_feature: HIJSMM301BAV5C.49.83.H06.1.454.light.4.raw

SEQ ID NO: 547951 - DNA, 501 bp, Homo sapiens
  misc_feature: HIJSMM301CSQF3.18.11.A11.1.454.light.4.raw
tacgagtatgcacgaccggtgctcgatttagctacgactgcaaggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 547952 - DNA, 473 bp, Homo sapiens; identical to SEQ ID NO: 535262
  misc_feature: HIJSMM301CKX4G.8.67.G01.1.454.light.4.raw

SEQ ID NO: 547953 - DNA, 489 bp, Homo sapiens; identical to SEQ ID NO: 535139
  misc_feature: HIJSMM301BA38L.14.55.E11.1.454.light.4.raw

SEQ ID NO: 547954 - DNA, 354 bp, Homo sapiens; identical to SEQ ID NO: 535026
  misc_feature: HIJSMM301A539D.19.22.B11.1.454.light.4.raw

SEQ ID NO: 547955 - DNA, 496 bp, Homo sapiens; identical to SEQ ID NO: 535541
  misc_feature: HIJSMM301BDVC0.3.33.C11.1.454.light.4.raw

SEQ ID NO: 547956 - DNA, 491 bp, Homo sapiens; identical to SEQ ID NO: 536211
  misc_feature: HIJSMM301AM61L.16.53.E09.1.454.light.4.raw

SEQ ID NO: 547957 - DNA, 486 bp, Homo sapiens; identical to SEQ ID NO: 535385
  misc_feature: HIJSMM301DQQNM.19.71.G05.1.454.light.4.raw

SEQ ID NO: 547958 - DNA, 467 bp, Homo sapiens; identical to SEQ ID NO: 535997
  misc_feature: HIJSMM301B7GKP.5.36.D03.1.454.light.4.raw

SEQ ID NO: 547959 - DNA, 502 bp, Homo sapiens
  misc_feature: HIJSMM301EJDBL.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaatgaccgtcctaggtcagcccaaggctgccccctcggtcactctgtt

SEQ ID NO: 547960 - DNA, 484 bp, Homo sapiens; identical to SEQ ID NO: 541039
  misc_feature: HIJSMM301CB0JQ.46.35.D02.1.454.light.4.raw

SEQ ID NO: 547961 - DNA, 492 bp, Homo sapiens; identical to SEQ ID NO: 535426
  misc_feature: HIJSMM301AJPM4.47.78.H01.1.454.light.4.raw

SEQ ID NO: 547962 - DNA, 484 bp, Homo sapiens; identical to SEQ ID NO: 535441
  misc_feature: HIJSMM301E1UEO.26.60.F05.1.454.light.4.raw

SEQ ID NO: 547963 - DNA, 494 bp, Homo sapiens; identical to SEQ ID NO: 536444
  misc_feature: HIJSMM301D22VI.26.72.G06.1.454.light.4.raw

SEQ ID NO: 547964 - DNA, 502 bp, Homo sapiens; identical to SEQ ID NO: 537363
  misc_feature: HIJSMM301BIWUM.18.23.C01.1.454.light.4.raw

SEQ ID NO: 547965 - DNA, 502 bp, Homo sapiens
  misc_feature: HIJSMM301DX0L2.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggtcaggggaccaaggtggagatcagacgaactgtggctgcaccatctgtcttcatcttccccg

SEQ ID NO: 547966 - DNA, 510 bp, Homo sapiens
  misc_feature: HIJSMM301DW6VJ.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtctaagtcagcccaaggctgccccctggtcactctcgtt

SEQ ID NO: 547967 - DNA, 505 bp, Homo sapiens
  misc_feature: HIJSMM301CVNPB.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctgaccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaacgaactgtggctgcaccatctgtctt

SEQ ID NO: 547968 - DNA, 499 bp, Homo sapiens
  misc_feature: HIJSMM301DZT1B.21.22.B11.1.454.light.4.raw
  modified_base (417)..(417): a, c, t, g, unknown or other
  modified_base (459)..(459): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtncatcacgggacgcaacatgggatgacaatctgagcggttggngttcggcggaggaccaaactgaccgtctaggtcagcccaa

SEQ ID NO: 547969 - DNA, 494 bp, Homo sapiens; identical to SEQ ID NO: 536974
  misc_feature: HIJSMM301B72CE.16.86.H09.1.454.light.4.raw

SEQ ID NO: 547970 - DNA, 493 bp, Homo sapiens
  misc_feature: HIJSMM301AP0NI.40.53.E09.1.454.light.4.raw
tctagcgactcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaactgtggc

SEQ ID NO: 547971 - DNA, 484 bp, Homo sapiens; identical to SEQ ID NO: 535240
  misc_feature: HIJSMM301BRWCN.47.60.F05.1.454.light.4.raw

SEQ ID NO: 547972 - DNA, 499 bp, Homo sapiens
  misc_feature: HIJSMM301DYIVY.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccgggaccaaagtggaaatcaaacgaactgtggctgcaccatctgtcttcatcttcccgccat

SEQ ID NO: 547973 - DNA, 492 bp, Homo sapiens
  misc_feature: HIJSMM301AOVPS.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcaagtgagtctgggacagacttcactctcaccatcagcagcctgcagtctgaagattttgcagtctattactgtcagcaatataattactggctctctttcggcgggggaccgaagctggagatcaaccgaactgtggctgca

SEQ ID NO: 547974 - DNA, 507 bp, Homo sapiens
  misc_feature: HIJSMM301DHEEH.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggcgggaccaagctgaccgtcctaggtcagcccaaggctgccccctcggtcta

SEQ ID NO: 547975 - DNA, 497 bp, Homo sapiens
  misc_feature: HIJSMM301EHXBB.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggaggatcaaacgaaactgtggctgcaccatctgtctt

SEQ ID NO: 547976 - DNA, 484 bp, Homo sapiens
  misc_feature: HIJSMM301DI0T8.5.40.D07.1.454.light.4.raw
atcagacacgcacgaccggtgctcgatttagtgatagagcgtaacacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccat

SEQ ID NO: 547977 - DNA, 492 bp, Homo sapiens
  misc_feature: HIJSMM301C6PGR.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtatataactggcctccgtacatgtacacttttggccaggggaccaacctggagatcagacgaa

SEQ ID NO: 547978 - DNA, 513 bp, Homo sapiens; identical to SEQ ID NO: 535244
  misc_feature: HIJSMM301D4P1L.17.33.C11.1.454.light.4.raw

SEQ ID NO: 547979 - DNA, 486 bp, Homo sapiens; identical to SEQ ID NO: 535043
  misc_feature: HIJSMM301C7HB4.46.35.D02.1.454.light.4.raw

SEQ ID NO: 547980 - DNA, 493 bp, Homo sapiens; identical to SEQ ID NO: 540903
  misc_feature: HIJSMM301DZX2R.10.20.B09.1.454.light.4.raw

SEQ ID NO: 547981 - DNA, 498 bp, Homo sapiens; identical to SEQ ID NO: 537020
  misc_feature: HIJSMM301BGJQU.26.26.C04.1.454.light.4.raw

SEQ ID NO: 547982 - DNA, 496 bp, Homo sapiens; identical to SEQ ID NO: 535109
  misc_feature: HIJSMM301CLVEU.16.78.H01.1.454.light.4.raw

SEQ ID NO: 547983 - DNA, 501 bp, Homo sapiens
  misc_feature: HIJSMM301D5HJY.51.26.C04.1.454.light.4.raw
cgatcgtatacacgaccggtgctcgatttagtctagcgactttgggtttggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccaggtctgaccgtcctaggtcagccaaggctgcccctcggtcactctgttcccgt

SEQ ID NO: 547984 - DNA, 506 bp, Homo sapiens
  misc_feature: HIJSMM301C1OYG.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtcta

SEQ ID NO: 547985 - DNA, 504 bp, Homo sapiens
  misc_feature: HIJSMM301AF4M4.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcgggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggaggggacccacctgaccgtcttaggtcagcccaaggctgccccctcggtcact

SEQ ID NO: 547986 - DNA, 511 bp, Homo sapiens
  misc_feature: HIJSMM301DXIH5.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccgaaaattagagatcaaacgaactgtggctgcaccatctgtcttcatcttcccg

SEQ ID NO: 547987 - DNA, 484 bp, Homo sapiens; identical to SEQ ID NO: 535400
  misc_feature: HIJSMM301A6L3G.46.26.C04.1.454.light.4.raw

SEQ ID NO: 547988 - DNA, 491 bp, Homo sapiens; identical to SEQ ID NO: 542796
  misc_feature: HIJSMM301ARY2R.19.57.F02.1.454.light.4.raw

SEQ ID NO: 547989 - DNA, 501 bp, Homo sapiens; identical to SEQ ID NO: 536818
  misc_feature: HIJSMM301D5GUE.12.82.H05.1.454.light.4.raw

SEQ ID NO: 547990 - DNA, 515 bp, Homo sapiens
  misc_feature: HIJSMM301B59JD.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctcgttcccgccctcctc

SEQ ID NO: 547991 - DNA, 490 bp, Homo sapiens; identical to SEQ ID NO: 541141
  misc_feature: HIJSMM301DGCU7.47.38.D05.1.454.light.4.raw

SEQ ID NO: 547992 - DNA, 494 bp, Homo sapiens; identical to SEQ ID NO: 535276
  misc_feature: HIJSMM301C8WTD.16.6.A06.1.454.light.4.raw

SEQ ID NO: 547993 - DNA, 484 bp, Homo sapiens; identical to SEQ ID NO: 538247
  misc_feature: HIJSMM301AXDME.14.53.E09.1.454.light.4.raw

SEQ ID NO: 547994 - DNA, 485 bp, Homo sapiens; identical to SEQ ID NO: 536075
  misc_feature: HIJSMM301DT0FN.17.21.B10.1.454.light.4.raw

SEQ ID NO: 547995 - DNA, 512 bp, Homo sapiens; identical to SEQ ID NO: 539198
  misc_feature: HIJSMM301A3DRF.17.33.C11.1.454.light.4.raw

SEQ ID NO: 547996 - DNA, 498 bp, Homo sapiens
  misc_feature: HIJSMM301CYYQI.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcgcggagggaccaaggtgaggatcaaacgaactgtggctgcacca

SEQ ID NO: 547997 - DNA, 512 bp, Homo sapiens
  misc_feature: HIJSMM301C1KM0.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggtccgggggaccgaccgtggaaatacaaacgaactagtggctgcaccatctgtctt

SEQ ID NO: 547998 - DNA, 518 bp, Homo sapiens; identical to SEQ ID NO: 539372
  misc_feature: HIJSMM301D3XGH.7.86.H09.1.454.light.4.raw

SEQ ID NO: 547999 - DNA, 486 bp, Homo sapiens; identical to SEQ ID NO: 535043
  misc_feature: HIJSMM301C0ZWJ.46.35.D02.1.454.light.4.raw

SEQ ID NO: 548000 - DNA, 510 bp, Homo sapiens
  misc_feature: HIJSMM301DZERZ.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggcccaggtgaccgtcctacgtcagcccaagg

SEQ ID NO: 548001 - DNA, 418 bp, Homo sapiens; identical to SEQ ID NO: 536277
  misc_feature: HIJSMM301AFSIQ.19.86.H09.1.454.light.4.raw

SEQ ID NO: 548002 - DNA, 448 bp, Homo sapiens
  misc_feature: HIJSMM301C0O97.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctcctggctgaggatgaggctgactattactgccagtcctatgacatgaggctgagtggttcgtatgtcttcggatctgggaccaaggtcaccgtcctaagtcagcccaaggccaacccctctgtcactcctgttcccgccctcctccatactcgta

SEQ ID NO: 548003 - DNA, 505 bp, Homo sapiens; identical to SEQ ID NO: 547532
  misc_feature: HIJSMM301B9ASH.8.1.A01.1.454.light.4.raw

SEQ ID NO: 548004 - DNA, 496 bp, Homo sapiens
  misc_feature: HIJSMM301CBZ32.3.35.D02.1.454.light.4.raw
agacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctggagatcaaacgaactgtggctgcacc

SEQ ID NO: 548005 - DNA, 501 bp, Homo sapiens
  misc_feature: HIJSMM301AMRIG.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcgccggggaccgacgtgaatcaacgaactgtgctgcaccatctgtcttcta

SEQ ID NO: 548006 - DNA, 493 bp, Homo sapiens; identical to SEQ ID NO: 535047
  misc_feature: HIJSMM301BOXNV.16.53.E09.1.454.light.4.raw

SEQ ID NO: 548007 - DNA, 512 bp, Homo sapiens
  misc_feature: HIJSMM301AJFII.49.34.D01.1.454.light.4.raw
agtcgagagacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 548008 - DNA, 505 bp, Homo sapiens
  misc_feature: HIJSMM301DLNU7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtggaaatacaaacgaactagtggctgcaccatctgtcttctatcttccccg

SEQ ID NO: 548009 - DNA, 473 bp, Homo sapiens; identical to SEQ ID NO: 535262
  misc_feature: HIJSMM301B93RU.8.67.G01.1.454.light.4.raw

SEQ ID NO: 548010 - DNA, 517 bp, Homo sapiens
  misc_feature: HIJSMM301BL172.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccaggtcaccgtcctaagtcagcccagggccaaccccactgtcactctgttcccaccctcctcgacacg

SEQ ID NO: 548011 - DNA, 497 bp, Homo sapiens; identical to SEQ ID NO: 535664
  misc_feature: HIJSMM301EQ51V.22.14.B03.1.454.light.4.raw

SEQ ID NO: 548012 - DNA, 504 bp, Homo sapiens; identical to SEQ ID NO: 537659
  misc_feature: HIJSMM301AF40O.13.55.E11.1.454.light.4.raw

SEQ ID NO: 548013 - DNA, 523 bp, Homo sapiens
  misc_feature: HIJSMM301BQDTM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccgccct

SEQ ID NO: 548014 - DNA, 454 bp, Homo sapiens; identical to SEQ ID NO: 534964
  misc_feature: HIJSMM301D118C.19.86.H09.1.454.light.4.raw

SEQ ID NO: 548015 - DNA, 486 bp, Homo sapiens; identical to SEQ ID NO: 535385
  misc_feature: HIJSMM301CMPLW.19.71.G05.1.454.light.4.raw

SEQ ID NO: 548016 - DNA, 498 bp, Homo sapiens
  misc_feature: HIJSMM301EUXM8.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccgaaggaccgaaggtggaagtcaaacgaactagtggctgcgaccatctgtcttcatcttcccgt

SEQ ID NO: 548017 - DNA, 504 bp, Homo sapiens
  misc_feature: HIJSMM301BKQO2.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaaggaccaaggtggaagtcaagcgaactgtggctgcaccatctgtcttcatcttccgcc

SEQ ID NO: 548018 - DNA, 515 bp, Homo sapiens
  misc_feature: HIJSMM301D3X5S.48.17.B06.1.454.light.4.raw
agtatacatacacgaccggtgctcgatttagtcgatagtgaaggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccgccct

SEQ ID NO: 548019 - DNA, 484 bp, Homo sapiens; identical to SEQ ID NO: 535400
  misc_feature: HIJSMM301DWT72.46.26.C04.1.454.light.4.raw

SEQ ID NO: 548020 - DNA, 491 bp, Homo sapiens; identical to SEQ ID NO: 536211
  misc_feature: HIJSMM301AL6LW.16.53.E09.1.454.light.4.raw

SEQ ID NO: 548021 - DNA, 493 bp, Homo sapiens; identical to SEQ ID NO: 536534
  misc_feature: HIJSMM301ATL0R.43.72.G06.1.454.light.4.raw

SEQ ID NO: 548022 - DNA, 488 bp, Homo sapiens
  misc_feature: HIJSMM301CCA4P.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgtgaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccg

SEQ ID NO: 548023 - DNA, 501 bp, Homo sapiens; identical to SEQ ID NO: 535509
  misc_feature: HIJSMM301C6CC5.15.56.F01.1.454.light.4.raw

SEQ ID NO: 548024 - DNA, 522 bp, Homo sapiens
  misc_feature: HIJSMM301DBQ70.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattatgtacaaacaattatttattatactttcggtagggtacgttccggaccgaacgggaaccgtaaggtaggtatactcgaagaacgtaactggtcgggctcga

SEQ ID NO: 548025 - DNA, 490 bp, Homo sapiens
  misc_feature: HIJSMM301DYNKW.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactctccgaggctcactttcggcggagggaccaaggtggagatcaaacgaa

SEQ ID NO: 548026 - DNA, 497 bp, Homo sapiens; identical to SEQ ID NO: 535286
  misc_feature: HIJSMM301BC83R.18.59.F04.1.454.light.4.raw

SEQ ID NO: 548027 - DNA, 494 bp, Homo sapiens; identical to SEQ ID NO: 539865
  misc_feature: HIJSMM301B0M06.9.1.A01.1.454.light.4.raw

SEQ ID NO: 548028 - DNA, 493 bp, Homo sapiens
  misc_feature: HIJSMM301AMX1J.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggtggagggaccaaggtggagatcaaacgaactgtggctgcaccatctgtcttcta

SEQ ID NO: 548029 - DNA, 501 bp, Homo sapiens; identical to SEQ ID NO: 542364
  misc_feature: HIJSMM301BZB9X.7.71.G05.1.454.light.4.raw

SEQ ID NO: 548030 - DNA, 493 bp, Homo sapiens
  misc_feature: HIJSMM301A0XC3.51.34.D01.1.454.light.4.raw
cgatcgtatacacgaccggtgctcgatttagatcgtctgtgttgggtttggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactc

SEQ ID NO: 548031 - DNA, 508 bp, Homo sapiens; identical to SEQ ID NO: 536388
  misc_feature: HIJSMM301DGMCC.11.57.F02.1.454.light.4.raw

SEQ ID NO: 548032 - DNA, 489 bp, Homo sapiens; identical to SEQ ID NO: 535139
  misc_feature: HIJSMM301AJWZO.14.55.E11.1.454.light.4.raw

SEQ ID NO: 548033 - DNA, 481 bp, Homo sapiens
  misc_feature: HIJSMM301DA4MU.48.87.H10.1.454.light.4.raw
agtatacatacacgaccggtgctcgatttagcagtactgcgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgttggtgtttggcggagggaccaagctgaccgtcct

SEQ ID NO: 548034 - DNA, 383 bp, Homo sapiens; identical to SEQ ID NO: 447524
  misc_feature: HIJSMM301BV1MV.41.26.C04.1.454.light.4.raw

SEQ ID NO: 548035 - DNA, 496 bp, Homo sapiens; identical to SEQ ID NO: 535109
  misc_feature: HIJSMM301CIFHT.16.78.H01.1.454.light.4.raw

SEQ ID NO: 548036 - DNA, 460 bp, Homo sapiens; identical to SEQ ID NO: 537107
  misc_feature: HIJSMM301CU6T4.22.28.C06.1.454.light.4.raw

SEQ ID NO: 548037 - DNA, 521 bp, Homo sapiens; identical to SEQ ID NO: 536990
  misc_feature: HIJSMM301AWL95.27.23.C01.1.454.light.4.raw
  modified_base (517)..(517): a, c, t, g, unknown or other

SEQ ID NO: 548038 - DNA, 488 bp, Homo sapiens; identical to SEQ ID NO: 535081
  misc_feature: HIJSMM301CH840.26.23.C01.1.454.light.4.raw

SEQ ID NO: 548039 - DNA, 443 bp, Homo sapiens
  misc_feature: HIJSMM301CZPXL.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagccaaggctgccccctcggtcactctgttcccaccctcctccgtgtctgat

SEQ ID NO: 548040 - DNA, 482 bp, Homo sapiens; identical to SEQ ID NO: 535352
  misc_feature: HIJSMM301AD6CI.16.81.H04.1.454.light.4.raw

SEQ ID NO: 548041 - DNA, 488 bp, Homo sapiens
  misc_feature: HIJSMM301EBHXN.49.59.F04.1.454.light.4.raw
agtcgagagacacgaccggtgctcgatttagtacacacacttagggattggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtt

SEQ ID NO: 548042 - DNA, 509 bp, Homo sapiens
  misc_feature: HIJSMM301A1T65.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtaggagtatcaaacgaaactgtggctgcaccatctgtt

SEQ ID NO: 548043 - DNA, 443 bp, Homo sapiens
  misc_feature: HIJSMM301DI5XG.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgcctcctcgacacgcgag

SEQ ID NO: 548044 - DNA, 485 bp, Homo sapiens
  misc_feature: HIJSMM301CS9II.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggtcgctcaccttcggccaagggacacgactggagattaaacgaactgtggctgcaccat

SEQ ID NO: 548045 - DNA, 482 bp, Homo sapiens
  misc_feature: HIJSMM301AZFKG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaactgtggctgcaccatct

SEQ ID NO: 548046 - DNA, 497 bp, Homo sapiens; identical to SEQ ID NO: 538061
  misc_feature: HIJSMM301DYL4L.16.46.E02.1.454.light.4.raw

SEQ ID NO: 548047 - DNA, 488 bp, Homo sapiens
  misc_feature: HIJSMM301A00C2.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggacccaagctggagatcaaacgaa

SEQ ID NO: 548048 - DNA, 502 bp, Homo sapiens; identical to SEQ ID NO: 541971
  misc_feature: HIJSMM301B4HCE.4.39.D06.1.454.light.4.raw

SEQ ID NO: 548049 - DNA, 486 bp, Homo sapiens; identical to SEQ ID NO: 535290
  misc_feature: HIJSMM301CJ2EC.3.12.B01.1.454.light.4.raw

SEQ ID NO: 548050 - DNA, 510 bp, Homo sapiens; identical to SEQ ID NO: 535855
  misc_feature: HIJSMM301CK4BL.17.33.C11.1.454.light.4.raw

SEQ ID NO: 548051 - DNA, 488 bp, Homo sapiens; identical to SEQ ID NO: 537260
  misc_feature: HIJSMM301B4VEZ.47.70.G04.1.454.light.4.raw

SEQ ID NO: 548052 - DNA, 502 bp, Homo sapiens
  misc_feature: HIJSMM301B2PJ0.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggacgaacggtggagtctaacgaactgtggctgcaccatctgtcttctatcttcccg

SEQ ID NO: 548053 - DNA, 502 bp, Homo sapiens
  misc_feature: HIJSMM301C5ZPU.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctcctcta

SEQ ID NO: 548054 - DNA, 498 bp, Homo sapiens
  misc_feature: HIJSMM301AFB6T.49.31.C09.1.454.light.4.raw
agtcgagagacacgaccggtgctcgatttagacgtctcatcaaggaaggaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattatttctgcagctcatatgcaggcagcaacaattttgtgatattcggcggagggaccaagctgaccgtcctaggtcagcccaaggctgccccctcggtcact

SEQ ID NO: 548055 - DNA, 520 bp, Homo sapiens
  misc_feature: HIJSMM301AGJPQ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccggaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccaccctcctccacg

SEQ ID NO: 548056 - DNA, 478 bp, Homo sapiens; identical to SEQ ID NO: 535129
  misc_feature: HIJSMM301DVSIY.11.11.A11.1.454.light.4.raw

SEQ ID NO: 548057 - DNA, 477 bp, Homo sapiens
  misc_feature: HIJSMM301C3EUC.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagatttgcaacttactattgtcaacaggctaacagtttcccgctcaccttcggcgggggaccgaaggtggagatcaaacgaactgtggctgcacc

SEQ ID NO: 548058 - DNA, 484 bp, Homo sapiens
  misc_feature: HIJSMM301C477I.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaactgtggctgcacatctgtt

SEQ ID NO: 548059 - DNA, 343 bp, Homo sapiens; identical to SEQ ID NO: 541810
  misc_feature: HIJSMM301BI3BO.12.87.H10.1.454.light.4.raw

SEQ ID NO: 548060 - DNA, 494 bp, Homo sapiens
  misc_feature: HIJSMM301ALTGD.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgaggtggagatacaaacgaactgtggctgcaccatctgtcttcat

SEQ ID NO: 548061 - DNA, 501 bp, Homo sapiens; identical to SEQ ID NO: 536867
  misc_feature: HIJSMM301BH565.5.86.H09.1.454.light.4.raw

SEQ ID NO: 548062 - DNA, 495 bp, Homo sapiens; identical to SEQ ID NO: 547042
  misc_feature: HIJSMM301A76C0.51.59.F04.1.454.light.4.raw

SEQ ID NO: 548063 - DNA, 455 bp, Homo sapiens; identical to SEQ ID NO: 542082
  misc_feature: HIJSMM301C27BW.19.86.H09.1.454.light.4.raw

SEQ ID NO: 548064 - DNA, 498 bp, Homo sapiens; identical to SEQ ID NO: 537020
  misc_feature: HIJSMM301AO162.26.26.C04.1.454.light.4.raw

SEQ ID NO: 548065 - DNA, 491 bp, Homo sapiens
  misc_feature: HIJSMM301C3EHW.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcggagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 548066 - DNA, 495 bp, Homo sapiens
  misc_feature: HIJSMM301C57NQ.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 548067 - DNA, 503 bp, Homo sapiens
  misc_feature: HIJSMM301AV5OB.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgcccccc

SEQ ID NO: 548068 - DNA, 486 bp, Homo sapiens; identical to SEQ ID NO: 535043
  misc_feature: HIJSMM301BX0Q4.46.35.D02.1.454.light.4.raw

SEQ ID NO: 548069 - DNA, 485 bp, Homo sapiens; identical to SEQ ID NO: 535985
  misc_feature: HIJSMM301CZ3U2.15.1.A01.1.454.light.4.raw

SEQ ID NO: 548070 - DNA, 460 bp, Homo sapiens; identical to SEQ ID NO: 536053
  misc_feature: HIJSMM301AVN9P.22.28.C06.1.454.light.4.raw

SEQ ID NO: 548071 - DNA, 482 bp, Homo sapiens
  misc_feature: HIJSMM301CGT4C.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaactagtggctgcaccta

SEQ ID NO: 548072 - DNA, 522 bp, Homo sapiens; identical to SEQ ID NO: 540296
  misc_feature: HIJSMM301EFKSZ.5.27.C05.1.454.light.4.raw

SEQ ID NO: 548073 - DNA, 472 bp, Homo sapiens; identical to SEQ ID NO: 535898
  misc_feature: HIJSMM301EV2RM.15.8.A08.1.454.light.4.raw

SEQ ID NO: 548074 - DNA, 513 bp, Homo sapiens
  misc_feature: HIJSMM301DHH24.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccacgtttccggccctcgggaccaaggtggaggatcaaacgaactgtggctgcaccatctgtcttcta

SEQ ID NO: 548075 - DNA, 486 bp, Homo sapiens; identical to SEQ ID NO: 535043
  misc_feature: HIJSMM301EZU40.46.35.D02.1.454.light.4.raw

SEQ ID NO: 548076 - DNA, 476 bp, Homo sapiens; identical to SEQ ID NO: 537368
  misc_feature: HIJSMM301DA8MP.7.83.H06.1.454.light.4.raw

SEQ ID NO: 548077 - DNA, 486 bp, Homo sapiens; identical to SEQ ID NO: 535385
  misc_feature: HIJSMM301A3RPG.19.71.G05.1.454.light.4.raw

SEQ ID NO: 548078 - DNA, 520 bp, Homo sapiens; identical to SEQ ID NO: 535773
  misc_feature: HIJSMM301CZ5C2.41.19.B08.1.454.light.4.raw

SEQ ID NO: 548079 - DNA, 502 bp, Homo sapiens
  misc_feature: HIJSMM301D5Q78.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggcccccgggtcacccttcggccaagggacacggactggacatgaaacgaactgtggctgcaccatctgtcttcta

SEQ ID NO: 548080 - DNA, 495 bp, Homo sapiens; identical to SEQ ID NO: 542851
  misc_feature: HIJSMM301BH80L.51.81.H04.1.454.light.4.raw

SEQ ID NO: 548081 - DNA, 509 bp, Homo sapiens
  misc_feature: HIJSMM301DCXU9.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagagtcaaacgaactgtggctgcaccatctgtcttcta

SEQ ID NO: 548082 - DNA, 490 bp, Homo sapiens; identical to SEQ ID NO: 537951
  misc_feature: HIJSMM301E1R65.19.57.F02.1.454.light.4.raw

SEQ ID NO: 548083 - DNA, 487 bp, Homo sapiens
  misc_feature: HIJSMM301BAFSF.49.87.H10.1.454.light.4.raw
agtcgagagacacgaccggtgctcgatttagcagtactgcgttgggtttggggagagccctggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaa

SEQ ID NO: 548084 - DNA, 516 bp, Homo sapiens
  misc_feature: HIJSMM301CR4WQ.48.81.H04.1.454.light.4.raw
agtatacatacacgaccggtgctcgatttagtagtgtagattcgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacacgcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggtcgggtcttcggcggagggaccaagctgaccgtcctacgtcagcccaaggctcgtccccccg

SEQ ID NO: 548085 - DNA, 415 bp, Homo sapiens; identical to SEQ ID NO: 536482
  misc_feature: HIJSMM301DVP1O.16.46.E02.1.454.light.4.raw

SEQ ID NO: 548086 - DNA, 489 bp, Homo sapiens; identical to SEQ ID NO: 535139
  misc_feature: HIJSMM301CZ0YQ.14.55.E11.1.454.light.4.raw

SEQ ID NO: 548087 - DNA, 492 bp, Homo sapiens
  misc_feature: HIJSMM301AZBPL.10.77.G11.1.454.light.4.raw
catagtagtgcacgaccggtgctcgatttagctagtcactcaagggaaaggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactgtggctgcaccatctgt

SEQ ID NO: 548088 - DNA, 447 bp, Homo sapiens
  misc_feature: HIJSMM301CH1BV.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 548089 - DNA, 483 bp, Homo sapiens; identical to SEQ ID NO: 536697
  misc_feature: HIJSMM301EGA2Z.46.26.C04.1.454.light.4.raw

SEQ ID NO: 548090 - DNA, 486 bp, Homo sapiens; identical to SEQ ID NO: 535290
  misc_feature: HIJSMM301D2BPX.3.12.B01.1.454.light.4.raw

SEQ ID NO: 548091 - DNA, 424 bp, Homo sapiens
  misc_feature: HIJSMM301BTTT5.9.25.C03.1.454.light.4.raw
tgatacgtctcacgaccggtgctcgatttagtagtgtagatttgggtttgggaacctatgaacattctgtcagtcggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcgggtcgaagccggggatgaggccgactatttctgtcagctgtgggattctcatgatggtaggtgggggaatcttcggcggagggaccaggctgaccgtcctaagtcagcccaaggctcgcccctcggtcactctgttcccaccctcctcagacgtatca

SEQ ID NO: 548092 - DNA, 496 bp, Homo sapiens; identical to SEQ ID NO: 536802
  misc_feature: HIJSMM301BBZI3.5.24.C02.1.454.light.4.raw

SEQ ID NO: 548093 - DNA, 511 bp, Homo sapiens; identical to SEQ ID NO: 541720
  misc_feature: HIJSMM301CTYJE.5.58.F03.1.454.light.4.raw

SEQ ID NO: 548094 - DNA, 501 bp, Homo sapiens
  misc_feature: HIJSMM301BQQPY.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcg

SEQ ID NO: 548095 - DNA, 517 bp, Homo sapiens
  misc_feature: HIJSMM301EGZZ5.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctccct

SEQ ID NO: 548096 - DNA, 468 bp, Homo sapiens
  misc_feature: HIJSMM301BIHUB.5.28.C06.1.454.light.4.raw
atcagacacgcacgaccggtgctcgatttagagctcacgtattgggtttggggactttccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccatctgtcttcatcttcccgccat

SEQ ID NO: 548097 - DNA, 503 bp, Homo sapiens
  misc_feature: HIJSMM301C87YS.49.48.E04.1.454.light.4.raw
agtcgagagacacgaccggtgctcgatttagagagcgtcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactatttactcaacagacagcagtgccgagggggtcttcggcggagggaccaaggctgaccgtcctaggtcagcccaaggctgccccctcggtcactctgtt

SEQ ID NO: 548098 - DNA, 497 bp, Homo sapiens; identical to SEQ ID NO: 534982
  misc_feature: HIJSMM301DNCAK.26.80.H03.1.454.light.4.raw

SEQ ID NO: 548099 - DNA, 462 bp, Homo sapiens
  misc_feature: HIJSMM301DYV7Y.52.8.A08.1.454.light.4.raw
cgcagtacgacacgaccggtgctcgatttagcatactctacaggggagtcagtcccaaccaggacacagcatggacatgagggtccctgctcagctcctggggctcctgctgctctggctctcaggtgccagatgtgtcatccagatgacccagtctccatcctccctgcctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattaactgtcaacagtatgatagtctccgctcactttcggcgggggtaccgaggtggagatcgaagcgaa

SEQ ID NO: 548100 - DNA, 468 bp, Homo sapiens
  misc_feature: HIJSMM301A91TA.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccaggggaccaaaggtggatgtcaaccgaa

SEQ ID NO: 548101 - DNA, 485 bp, Homo sapiens
  misc_feature: HIJSMM301AQ8VO.40.81.H04.1.454.light.4.raw
tctagcgactcacgaccggtgctcgatttagtagtgtagattcgcggggtgatctgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaa

SEQ ID NO: 548102 - DNA, 496 bp, Homo sapiens; identical to SEQ ID NO: 535109
  misc_feature: HIJSMM301CEX2P.16.78.H01.1.454.light.4.raw

SEQ ID NO: 548103 - DNA, 445 bp, Homo sapiens; identical to SEQ ID NO: 536433
  misc_feature: HIJSMM301E0SB4.5.9.A09.1.454.light.4.raw

SEQ ID NO: 548104 - DNA, 454 bp, Homo sapiens; identical to SEQ ID NO: 536449
  misc_feature: HIJSMM301AUXKC.18.78.H01.1.454.light.4.raw

SEQ ID NO: 548105 - DNA, 494 bp, Homo sapiens
  misc_feature: HIJSMM301EU3W5.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggacgggaccgaaaggtggagatcaaacgaa

SEQ ID NO: 548106 - DNA, 502 bp, Homo sapiens; identical to SEQ ID NO: 542090
  misc_feature: HIJSMM301EW1NQ.2.76.G10.1.454.light.4.raw

SEQ ID NO: 548107 - DNA, 508 bp, Homo sapiens
  misc_feature: HIJSMM301D0SC0.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctacttggtggtgctgtgctattcggcggaggaccaagctgaccgtcttaagtcagcccaaggctcgccccctcggtcactctcgttccct

SEQ ID NO: 548108 - DNA, 514 bp, Homo sapiens
  misc_feature: HIJSMM301DBOOM.46.67.G01.1.454.light.4.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtggggtacttgcaacccgggatactactccaccttcggcttggacatctgggccgac

SEQ ID NO: 548109 - DNA, 494 bp, Homo sapiens; identical to SEQ ID NO: 534992
  misc_feature: HIJSMM301B5LOJ.9.1.A01.1.454.light.4.raw

SEQ ID NO: 548110 - DNA, 494 bp, Homo sapiens; identical to SEQ ID NO: 534992
  misc_feature: HIJSMM301D0VPM.9.1.A01.1.454.light.4.raw

SEQ ID NO: 548111 - DNA, 497 bp, Homo sapiens
  misc_feature: HIJSMM301D9HO6.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagttcgctctcgaagtgttcggcggagggaccgagctgaccgtcctacgtcagcccaaggctccg

SEQ ID NO: 548112 - DNA, 517 bp, Homo sapiens
  misc_feature: HIJSMM301B1YQ7.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcact

SEQ ID NO: 548113 - DNA, 522 bp, Homo sapiens
  misc_feature: HIJSMM301AUH9S.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgaccct

SEQ ID NO: 548114 - DNA, 497 bp, Homo sapiens; identical to SEQ ID NO: 535286
  misc_feature: HIJSMM301CWZUA.18.59.F04.1.454.light.4.raw

SEQ ID NO: 548115 - DNA, 485 bp, Homo sapiens; identical to SEQ ID NO: 535822
  misc_feature: HIJSMM301EIA9Z.14.53.E09.1.454.light.4.raw

SEQ ID NO: 548116 - DNA, 491 bp, Homo sapiens; identical to SEQ ID NO: 536211
  misc_feature: HIJSMM301ECWUH.16.53.E09.1.454.light.4.raw

SEQ ID NO: 548117 - DNA, 494 bp, Homo sapiens; identical to SEQ ID NO: 534992
  misc_feature: HIJSMM301CJ6QI.9.1.A01.1.454.light.4.raw

SEQ ID NO: 548118 - DNA, 502 bp, Homo sapiens
  misc_feature: HIJSMM301EON0L.5.86.H09.1.454.light.4.raw
atcagacacgcacgaccggtgctcgatttagtgctatagacgttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgcccctcgg

SEQ ID NO: 548119 - DNA, 493 bp, Homo sapiens
  misc_feature: HIJSMM301AIHGM.48.31.C09.1.454.light.4.raw
agtatacatacacgaccggtgctcgatttagacgtctcatcaaggaaggaaggggagtctcagtcaggacacagcatggacatgagggtccccgctcagctcctgggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcgccaaggaccaagtggagtcagacgaactgtggctgcaccatctgtcttcatcttcccg

SEQ ID NO: 548120 - DNA, 495 bp, Homo sapiens
  misc_feature: HIJSMM301CJYQY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccaatctgtcttcatcttccccg

SEQ ID NO: 548121 - DNA, 484 bp, Homo sapiens; identical to SEQ ID NO: 535211
  misc_feature: HIJSMM301EEBJC.47.46.E02.1.454.light.4.raw

SEQ ID NO: 548122 - DNA, 487 bp, Homo sapiens; identical to SEQ ID NO: 538190
  misc_feature: HIJSMM301BTWOH.47.70.G04.1.454.light.4.raw

SEQ ID NO: 548123 - DNA, 511 bp, Homo sapiens
  misc_feature: HIJSMM301DBOM6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacgaaacgaactagtggcgtgcaccatctgtcttctatcttccccg

SEQ ID NO: 548124 - DNA, 493 bp, Homo sapiens; identical to SEQ ID NO: 535657
  misc_feature: HIJSMM301B53DW.27.78.H01.1.454.light.4.raw

SEQ ID NO: 548125 - DNA, 477 bp, Homo sapiens
  misc_feature: HIJSMM301EQ1Q5.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaaa

SEQ ID NO: 548126 - DNA, 476 bp, Homo sapiens
  misc_feature: HIJSMM301A2Y09.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactgtggctgcaccat

SEQ ID NO: 548127 - DNA, 497 bp, Homo sapiens
  misc_feature: HIJSMM301DC9KZ.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctaaagattttgcagtttattactgtcagcagcgtagcaactccctcacgttcggcggagggaccaaggtggagatcaaacgaactgtggctgcaccatctgtcttcatcttcccgccat

SEQ ID NO: 548128 - DNA, 486 bp, Homo sapiens; identical to SEQ ID NO: 535043
  misc_feature: HIJSMM301A6D3M.46.35.D02.1.454.light.4.raw

SEQ ID NO: 548129 - DNA, 499 bp, Homo sapiens; identical to SEQ ID NO: 536578
  misc_feature: HIJSMM301EYGL4.22.27.C05.1.454.light.4.raw

SEQ ID NO: 548130 - DNA, 520 bp, Homo sapiens
  misc_feature: HIJSMM301CUI0I.14.78.H01.1.454.light.4.raw
cgtctagtaccacgaccggtgctcgatttagtgtgagtagtttgggtttgggggggtcgacaagaggcagcgctctcgggacggtctccaccatggcctgggcgtctgctgctcctcactctcctcactcaggacacagggtccgtcgggcccgacgtctgccctcgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 548131 - DNA, 441 bp, Homo sapiens; identical to SEQ ID NO: 534971
  misc_feature: HIJSMM301AQW8J.11.3.A03.1.454.light.4.raw

SEQ ID NO: 548132 - DNA, 489 bp, Homo sapiens; identical to SEQ ID NO: 535139
  misc_feature: HIJSMM301EZPD8.14.55.E11.1.454.light.4.raw

SEQ ID NO: 548133 - DNA, 495 bp, Homo sapiens; identical to SEQ ID NO: 546624
  misc_feature: HIJSMM301AQK22.52.38.D05.1.454.light.4.raw

SEQ ID NO: 548134 - DNA, 492 bp, Homo sapiens; identical to SEQ ID NO: 536010
  misc_feature: HIJSMM301AEO7D.10.20.B09.1.454.light.4.raw

SEQ ID NO: 548135 - DNA, 482 bp, Homo sapiens
  misc_feature: HIJSMM301CA3K0.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgcagggcaagtcagagtgttagtatttatttaaattggtatcagttcaaaccagggaaagccctaagctcctgatctatgctgcatccagtttacaaagtggggtcccatcaagattcagtggcagtggatctgggacagatttcactctcaccatcagtagtctacaacctgaagattttgcaacttactactgtcaacagattacgataccctcgctcactttcggcggagggaccaaggtggagatcaaacgaactgtggctgcacca

SEQ ID NO: 548136 - DNA, 459 bp, Homo sapiens
  misc_feature: HIJSMM301CASIS.18.78.H01.1.454.light.4.raw
tacgagtatgcacgaccggtgctcgatttagtgtgagtagtttggggtttggggctttgcctgggcccagtctggccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctctaggggtttctaatcgcttctctggctccaagtctggcaacacggctccctgaccatctctgggctccaggctgaggacgaggctgattattactgcagctcatatacaaggcaccagcactctctatgtcttcggaactgggaccaaggtcaccgtcctaggtcagcccaaggccaaccccactgtcactctgttcccaccctcctccatactcgta

SEQ ID NO: 548137 - DNA, 497 bp, Homo sapiens; identical to SEQ ID NO: 536376
  misc_feature: HIJSMM301BXR7X.22.9.A09.1.454.light.4.raw

SEQ ID NO: 548138 - DNA, 478 bp, Homo sapiens; identical to SEQ ID NO: 535129
  misc_feature: HIJSMM301COTN3.11.11.A11.1.454.light.4.raw

SEQ ID NO: 548139 - DNA, 478 bp, Homo sapiens
  misc_feature: HIJSMM301BGRV3.49.7.A07.1.454.light.4.raw
  modified_base (455)..(455): a, c, t, g, unknown or other
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctgccccctcggtnactctgttcccaccctcctctct

SEQ ID NO: 548140 - DNA, 521 bp, Homo sapiens; identical to SEQ ID NO: 538715
  misc_feature: HIJSMM301EVEE6.27.23.C01.1.454.light.4.raw

SEQ ID NO: 548141 - DNA, 496 bp, Homo sapiens
  misc_feature: HIJSMM301DLIVF.48.1.A01.1.454.light.4.raw
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacacgtttccctcccactttcggcggagggaccagggtggacgtacaaacgaactgtggctgcaccatctgtcttcatcttcccg

SEQ ID NO: 548142 - DNA, 444 bp, Homo sapiens; identical to SEQ ID NO: 535192
  misc_feature: HIJSMM301AZC0R.5.9.A09.1.454.light.4.raw

SEQ ID NO: 548143 - DNA, 496 bp, Homo sapiens; identical to SEQ ID NO: 535109
  misc_feature: HIJSMM301APLWX.16.78.H01.1.454.light.4.raw

SEQ ID NO: 548144 - DNA, 492 bp, Homo sapiens
  misc_feature: HIJSMM301C611A.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggccaagctgaccgtcctggtcagcccaaggctgccccctcggtcact

SEQ ID NO: 548145 - DNA, 454 bp, Homo sapiens; identical to SEQ ID NO: 536347
  misc_feature: HIJSMM301EHLQI.19.86.H09.1.454.light.4.raw

SEQ ID NO: 548146 - DNA, 489 bp, Homo sapiens
  misc_feature: HIJSMM301CWO4K.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtca

SEQ ID NO: 548147 - DNA, 497 bp, Homo sapiens; identical to SEQ ID NO: 536376
  misc_feature: HIJSMM301C04KA.22.9.A09.1.454.light.4.raw

SEQ ID NO: 548148 - DNA, 496 bp, Homo sapiens
  misc_feature: HIJSMM301ETGXR.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggatccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccta

SEQ ID NO: 548149 - DNA, 494 bp, Homo sapiens
  misc_feature: HIJSMM301ENLD8.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcacact

SEQ ID NO: 548150 - DNA, 513 bp, Homo sapiens
  misc_feature: HIJSMM301AJCN8.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccaccctcct

SEQ ID NO: 548151 - DNA, 443 bp, Homo sapiens; identical to SEQ ID NO: 548039
  misc_feature: HIJSMM301BEEXC.5.9.A09.1.454.light.4.raw

SEQ ID NO: 548152 - DNA, 492 bp, Homo sapiens
  misc_feature: HIJSMM301BV5TF.26.14.B03.1.454.light.4.raw
agactatactcacgaccggtgctcgatttagtgtgagtagttcgggttggggaggaactgctcagttaggacccagagggaaccgatggaagaccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctggggacagacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 548153 - DNA, 506 bp, Homo sapiens
  misc_feature: HIJSMM301CZ1S7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttctttaatccagtttgcaaatggtgtcccatcaaggttcagtggcagtggatctgggacacaattcactctcaccatcgctgatctgcagcctgaagattttgcaacttactactgtcaacagagtttcagtgtcccccggacgttcgccacgggaccgacagtagaatagagacgaactgtggcgtgcaccatctgtcttctatcttcccgcccta

SEQ ID NO: 548154 - DNA, 498 bp, Homo sapiens
  misc_feature: HIJSMM301EW4ZT.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 548155 - DNA, 447 bp, Homo sapiens; identical to SEQ ID NO: 535020
  misc_feature: HIJSMM301BBTLB.18.9.A09.1.454.light.4.raw

SEQ ID NO: 548156 - DNA, 490 bp, Homo sapiens
  misc_feature: HIJSMM301ASX8Y.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggccctccgacgttcggccaagggaccaaggtaggaatacaaacgaactgtggctgcaccat

SEQ ID NO: 548157 - DNA, 512 bp, Homo sapiens
  misc_feature: HIJSMM301CQV8V.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 548158 - DNA, 485 bp, Homo sapiens; identical to SEQ ID NO: 539951
  misc_feature: HIJSMM301CV21W.4.26.C04.1.454.light.4.raw

SEQ ID NO: 548159 - DNA, 444 bp, Homo sapiens; identical to SEQ ID NO: 537971
  misc_feature: HIJSMM301DEB3C.2.76.G10.1.454.light.4.raw

SEQ ID NO: 548160 - DNA, 475 bp, Homo sapiens
  misc_feature: HIJSMM301EOH22.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtcttcatcttcccgccat

SEQ ID NO: 548161 - DNA, 441 bp, Homo sapiens; identical to SEQ ID NO: 534971
  misc_feature: HIJSMM301AW2YI.11.3.A03.1.454.light.4.raw

SEQ ID NO: 548162 - DNA, 470 bp, Homo sapiens
  misc_feature: HIJSMM301AHB4T.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatactttctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 548163 - DNA, 507 bp, Homo sapiens
  misc_feature: HIJSMM301CNTKA.3.37.D04.1.454.light.4.raw
agacgcactccacgaccggtgctcgatttagtagcatactgttgggtttggggggggtcgtcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtctaggtcagcccaaggccaacccactgtcact

SEQ ID NO: 548164 - DNA, 453 bp, Homo sapiens
  misc_feature: HIJSMM301C9JBX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacagagta

SEQ ID NO: 548165 - DNA, 494 bp, Homo sapiens; identical to SEQ ID NO: 540664
  misc_feature: HIJSMM301B8PJ2.47.64.F09.1.454.light.4.raw

SEQ ID NO: 548166 - DNA, 502 bp, Homo sapiens; identical to SEQ ID NO: 541971
  misc_feature: HIJSMM301EBX3V.4.39.D06.1.454.light.4.raw

SEQ ID NO: 548167 - DNA, 480 bp, Homo sapiens
  misc_feature: HIJSMM301AH2T9.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggtccaggggaccaagctggagatcaatcgaa

SEQ ID NO: 548168 - DNA, 501 bp, Homo sapiens; identical to SEQ ID NO: 535873
  misc_feature: HIJSMM301DAGOO.17.27.C05.1.454.light.4.raw

SEQ ID NO: 548169 - DNA, 488 bp, Homo sapiens; identical to SEQ ID NO: 536554
  misc_feature: HIJSMM301DDZN6.26.37.D04.1.454.light.4.raw

SEQ ID NO: 548170 - DNA, 489 bp, Homo sapiens
  misc_feature: HIJSMM301AMY7Q.48.25.C03.1.454.light.4.raw
agtatacatacacgaccggtgctcgatttagtagtgtagatttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcg

SEQ ID NO: 548171 - DNA, 482 bp, Homo sapiens
  misc_feature: HIJSMM301AWE7E.52.38.D05.1.454.light.4.raw
  modified_base (429)..(429): a, c, t, g, unknown or other
cgcagtacgacacgaccggtgctcgatttagtatctgatagttgggtttggggtggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtcctaggtcagcccaaggctgccccct

SEQ ID NO: 548172 - DNA, 489 bp, Homo sapiens; identical to SEQ ID NO: 535386
  misc_feature: HIJSMM301DQ8KT.12.51.E07.1.454.light.4.raw

SEQ ID NO: 548173 - DNA, 477 bp, Homo sapiens; identical to SEQ ID NO: 537678
  misc_feature: HIJSMM301C17BU.12.1.A01.1.454.light.4.raw

SEQ ID NO: 548174 - DNA, 473 bp, Homo sapiens; identical to SEQ ID NO: 546369
  misc_feature: HIJSMM301DITQX.18.76.G10.1.454.light.4.raw

SEQ ID NO: 548175 - DNA, 498 bp, Homo sapiens
  misc_feature: HIJSMM301CUHFX.43.66.F11.1.454.light.4.raw
tgtgagtagtcacgaccggtgctcgatttagtcacgcgagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccg

SEQ ID NO: 548176 - DNA, 504 bp, Homo sapiens; identical to SEQ ID NO: 537430
  misc_feature: HIJSMM301AV5MX.12.53.E09.1.454.light.4.raw

SEQ ID NO: 548177 - DNA, 496 bp, Homo sapiens
  misc_feature: HIJSMM301EI0M9.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaagg

SEQ ID NO: 548178 - DNA, 498 bp, Homo sapiens
  misc_feature: HIJSMM301BFZF5.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccacggaagattcagcggcggtggatctagggcagatttcactctcaccatcaatcacctgcaggctgaggattttgcaacttactactgtcagcaggctaacaggctcgcccccaacccttcggccgacgggacgacgaacgtgaggattaaaacgtaactagtggctgcaccactctcgtt

SEQ ID NO: 548179 - DNA, 495 bp, Homo sapiens; identical to SEQ ID NO: 543094
  misc_feature: HIJSMM301A0O38.22.57.F02.1.454.light.4.raw

SEQ ID NO: 548180 - DNA, 510 bp, Homo sapiens; identical to SEQ ID NO: 535474
  misc_feature: HIJSMM301AYVCP.17.33.C11.1.454.light.4.raw

SEQ ID NO: 548181 - DNA, 486 bp, Homo sapiens; identical to SEQ ID NO: 535043
  misc_feature: HIJSMM301AQ9E2.46.35.D02.1.454.light.4.raw

SEQ ID NO: 548182 - DNA, 489 bp, Homo sapiens
  misc_feature: HIJSMM301CZ4MZ.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttctggacgttcggccaagggaccaaggtggatatcagacgaa

SEQ ID NO: 548183 - DNA, 503 bp, Homo sapiens
  misc_feature: HIJSMM301B8GJ5.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctcctcta

SEQ ID NO: 548184 - DNA, 518 bp, Homo sapiens
  misc_feature: HIJSMM301A8DKK.51.27.C05.1.454.light.4.raw
cgatcgtatacacgaccggtgctcgatttagacgcgatcgaagggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgttccccg

SEQ ID NO: 548185 - DNA, 514 bp, Homo sapiens
  misc_feature: HIJSMM301DLU13.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccct

SEQ ID NO: 548186 - DNA, 497 bp, Homo sapiens
  misc_feature: HIJSMM301BW7B5.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgcccctcggtcactctcgttcccgccctcctcgagtgcgtct

SEQ ID NO: 548187 - DNA, 500 bp, Homo sapiens
  misc_feature: HIJSMM301ESGM6.48.85.H08.1.454.light.4.raw
agtatacatacacgaccggtgctcgatttagtatcactcagtcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 548188 - DNA, 487 bp, Homo sapiens
  misc_feature: HIJSMM301DEPVF.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacaggatttcactctcaccatcagcagcctgcaggctgaagatgtggcagtttattattgtcaacaatattattatacttcgtggacgttcggccaagggaccaaggtggatatcagacgaactgtgg

SEQ ID NO: 548189 - DNA, 493 bp, Homo sapiens; identical to SEQ ID NO: 540127
  misc_feature: HIJSMM301A9LYZ.10.17.B06.1.454.light.4.raw

SEQ ID NO: 548190 - DNA, 457 bp, Homo sapiens
  misc_feature: HIJSMM301DQIXF.19.86.H09.1.454.light.4.raw
  modified_base (217)..(217): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgctttttanctataatgacgctgagcggtccttaagggtccctgaccgattctatggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacggagta

SEQ ID NO: 548191 - DNA, 501 bp, Homo sapiens
  misc_feature: HIJSMM301C8LBA.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaaggaccaaggtggagatcaacgaactgtggctgcaccatctgtcttcatcttcccgcat

SEQ ID NO: 548192 - DNA, 493 bp, Homo sapiens; identical to SEQ ID NO: 541365
  misc_feature: HIJSMM301C1LFK.4.27.C05.1.454.light.4.raw

SEQ ID NO: 548193 - DNA, 501 bp, Homo sapiens
  misc_feature: HIJSMM301D1Z0W.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaa

SEQ ID NO: 548194 - DNA, 485 bp, Homo sapiens; identical to SEQ ID NO: 536799
  misc_feature: HIJSMM301DK7P7.19.71.G05.1.454.light.4.raw

SEQ ID NO: 548195 - DNA, 490 bp, Homo sapiens
  misc_feature: HIJSMM301A86P0.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagtattttgaagtttattctgtctgcagtacaatcagtggcctcggacgttcggccaagggaccaaggtggaaatcaaacgaactgtggctgcaccatctgtcttcta

SEQ ID NO: 548196 - DNA, 493 bp, Homo sapiens; identical to SEQ ID NO: 540127
  misc_feature: HIJSMM301DFFLL.10.17.B06.1.454.light.4.raw

SEQ ID NO: 548197 - DNA, 491 bp, Homo sapiens; identical to SEQ ID NO: 535194
  misc_feature: HIJSMM301AGC9F.26.78.H01.1.454.light.4.raw

SEQ ID NO: 548198 - DNA, 453 bp, Homo sapiens; identical to SEQ ID NO: 536654
  misc_feature: HIJSMM301B50R8.19.86.H09.1.454.light.4.raw

SEQ ID NO: 548199 - DNA, 496 bp, Homo sapiens
  misc_feature: HIJSMM301EMGMR.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaaggaccgaacggtaggaagtacaaacgaactagtggctgcaccatctgtctt

SEQ ID NO: 548200 - DNA, 496 bp, Homo sapiens; identical to SEQ ID NO: 536248
  misc_feature: HIJSMM301C40UD.22.27.C05.1.454.light.4.raw

SEQ ID NO: 548201 - DNA, 494 bp, Homo sapiens; identical to SEQ ID NO: 535713
  misc_feature: HIJSMM301AJ12A.49.6.A06.1.454.light.4.raw

SEQ ID NO: 548202 - DNA, 474 bp, Homo sapiens
  misc_feature: HIJSMM301DHAPO.3.1.A01.1.454.light.4.raw
agacgcactccacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccat

SEQ ID NO: 548203 - DNA, 488 bp, Homo sapiens; identical to SEQ ID NO: 535568
  misc_feature: HIJSMM301B3OAP.21.4.A04.1.454.light.4.raw

SEQ ID NO: 548204 - DNA, 505 bp, Homo sapiens
  misc_feature: HIJSMM301AV1QE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcgagagggtcaccatctcttgttctggaggcaactccaacatcggaagtaattatgtattctggtatcagcaactcccaggaatggcccccaaacctcctcatccagaggaataatcagcggccctcaggggtccctcgaccgattctctggctcccaagtctggcacctcagcctccctgaccatcagtgggctccggtccgaggatgaggctgactattactgtgcatcacgggacgcaacatgggatgacaatctgagcggttgggtgttcggcggaggaccaaactgaccgtcctaggtcagcccaa

SEQ ID NO: 548205 - DNA, 485 bp, Homo sapiens; identical to SEQ ID NO: 535606
  misc_feature: HIJSMM301BTITE.47.46.E02.1.454.light.4.raw

SEQ ID NO: 548206 - DNA, 519 bp, Homo sapiens
  misc_feature: HIJSMM301CXWL1.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcaccg

SEQ ID NO: 548207 - DNA, 473 bp, Homo sapiens; identical to SEQ ID NO: 547830
  misc_feature: HIJSMM301CKAKG.15.81.H04.1.454.light.4.raw

SEQ ID NO: 548208 - DNA, 383 bp, Homo sapiens; identical to SEQ ID NO: 447524
  misc_feature: HIJSMM301CA635.41.26.C04.1.454.light.4.raw

SEQ ID NO: 548209 - DNA, 418 bp, Homo sapiens; identical to SEQ ID NO: 537546
  misc_feature: HIJSMM301CNCIR.19.86.H09.1.454.light.4.raw

SEQ ID NO: 548210 - DNA, 434 bp, Homo sapiens; identical to SEQ ID NO: 535153
  misc_feature: HIJSMM301COCHX.18.5.A05.1.454.light.4.raw

SEQ ID NO: 548211 - DNA, 497 bp, Homo sapiens; identical to SEQ ID NO: 535579
  misc_feature: HIJSMM301CP8GO.26.26.C04.1.454.light.4.raw

SEQ ID NO: 548212 - DNA, 484 bp, Homo sapiens
  misc_feature: HIJSMM301C5C2V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagtaactttggcgagggaccaagctggagatacaacgaactgtggctgcaccat

SEQ ID NO: 548213 - DNA, 495 bp, Homo sapiens; identical to SEQ ID NO: 548066
  misc_feature: HIJSMM301APK6W.3.31.C09.1.454.light.4.raw

SEQ ID NO: 548214 - DNA, 511 bp, Homo sapiens
  misc_feature: HIJSMM301CI3EZ.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 548215 - DNA, 501 bp, Homo sapiens; identical to SEQ ID NO: 535746
  misc_feature: HIJSMM301A5T0C.18.11.A11.1.454.light.4.raw

SEQ ID NO: 548216 - DNA, 497 bp, Homo sapiens; identical to SEQ ID NO: 535764
  misc_feature: HIJSMM301C3XIB.22.20.B09.1.454.light.4.raw

SEQ ID NO: 548217 - DNA, 486 bp, Homo sapiens; identical to SEQ ID NO: 535043
  misc_feature: HIJSMM301DNK4T.46.35.D02.1.454.light.4.raw

SEQ ID NO: 548218 - DNA, 485 bp, Homo sapiens; identical to SEQ ID NO: 535652
  misc_feature: HIJSMM301ECEWG.19.71.G05.1.454.light.4.raw

SEQ ID NO: 548219 - DNA, 486 bp, Homo sapiens
  misc_feature: HIJSMM301CV6Q4.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcaccatctgtcttca

SEQ ID NO: 548220 - DNA, 485 bp, Homo sapiens
  misc_feature: HIJSMM301A5USL.10.38.D05.1.454.light.4.raw
catagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccctcctccactactatg

SEQ ID NO: 548221 - DNA, 499 bp, Homo sapiens
  misc_feature: HIJSMM301C6GET.22.9.A09.1.454.light.4.raw
acatacgcgtcacgaccggtgctcgatttagcgagacgcgcagggggaggaactgctcagttaggacccaggagggaaccatggaacgccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 548222 - DNA, 476 bp, Homo sapiens; identical to SEQ ID NO: 541471
  misc_feature: HIJSMM301CCT2Z.13.4.A04.1.454.light.4.raw

SEQ ID NO: 548223 - DNA, 487 bp, Homo sapiens
  misc_feature: HIJSMM301AHVZF.51.70.G04.1.454.light.4.raw
cgatcgtatacacgaccggtgctcgatttagtgtagtgtgaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggaccagactgacccg

SEQ ID NO: 548224 - DNA, 490 bp, Homo sapiens
  misc_feature: HIJSMM301D4SS0.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagtattttgcaacttattactgtctacaagattcttcttacccctcggacgttcggccgacgggaccgaccggtggtagtgtcaagcgaacgtgtggctgcaccact

SEQ ID NO: 548225 - DNA, 511 bp, Homo sapiens
  misc_feature: HIJSMM301A3LR4.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgtcggccaacgggaccgaaggtaggaagtacaaacgaactagtggcgtgcaccactctgtcttctatcttccccg

SEQ ID NO: 548226 - DNA, 506 bp, Homo sapiens; identical to SEQ ID NO: 534969
  misc_feature: HIJSMM301BKNGQ.18.37.D04.1.454.light.4.raw

SEQ ID NO: 548227 - DNA, 517 bp, Homo sapiens
  misc_feature: HIJSMM301BOOJN.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggcactctgttcccaccctcctcacg

SEQ ID NO: 548228 - DNA, 493 bp, Homo sapiens
  misc_feature: HIJSMM301BZ1HN.52.42.D09.1.454.light.4.raw
cgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgt

SEQ ID NO: 548229 - DNA, 481 bp, Homo sapiens; identical to SEQ ID NO: 535993
  misc_feature: HIJSMM301DR7HF.21.25.C03.1.454.light.4.raw

SEQ ID NO: 548230 - DNA, 474 bp, Homo sapiens
  misc_feature: HIJSMM301CI5UO.8.49.E05.1.454.light.4.raw
ctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaacgaa

SEQ ID NO: 548231 - DNA, 517 bp, Homo sapiens; identical to SEQ ID NO: 539607
  misc_feature: HIJSMM301ANTPB.41.55.E11.1.454.light.4.raw

SEQ ID NO: 548232 - DNA, 486 bp, Homo sapiens; identical to SEQ ID NO: 535385
  misc_feature: HIJSMM301CCBTQ.19.71.G05.1.454.light.4.raw

SEQ ID NO: 548233 - DNA, 441 bp, Homo sapiens; identical to SEQ ID NO: 534971
  misc_feature: HIJSMM301AR7AK.11.3.A03.1.454.light.4.raw

SEQ ID NO: 548234 - DNA, 506 bp, Homo sapiens
  misc_feature: HIJSMM301A5795.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttaagtttggtatcagcagaaaccaggaaaagcccctaaagctgcagatgattggtccgtccagtttccaagatggggccccatcgagattccgcgtcagtggatctgggacagatttcactctcaccatcagcagcctgcagcctgaagattttgctaacttactattgtcagcaggcgcacaatttcccgctcactttcggcggtagggaccaaggtggagatcaaacgaactagtggctgcaccatctgtcttcattttcccg

SEQ ID NO: 548235 - DNA, 497 bp, Homo sapiens
  misc_feature: HIJSMM301AG9GS.19.71.G05.1.454.light.4.raw
  modified_base (485)..(485): a, c, t, g, unknown or other
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaacggtaggagtatcanacgaactagtgg

SEQ ID NO: 548236 - DNA, 444 bp, Homo sapiens; identical to SEQ ID NO: 535192
  misc_feature: HIJSMM301EAEZE.5.9.A09.1.454.light.4.raw

SEQ ID NO: 548237 - DNA, 492 bp, Homo sapiens
  misc_feature: HIJSMM301D7HT0.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggagggaccaaggtggagatcaaacgaactgtggctgcaccatctgtcttcatcttcccgcat

SEQ ID NO: 548238 - DNA, 509 bp, Homo sapiens
  misc_feature: HIJSMM301EMUZ3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacgaaactgtggctgcaccatctgtcttcactcttccccg

SEQ ID NO: 548239 - DNA, 481 bp, Homo sapiens
  misc_feature: HIJSMM301EYD04.41.17.B06.1.454.light.4.raw
tctatactatcacgaccggtgctcgatttagtcgatagtgaaggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcacttttcggcggaggggaccaaggtggagatcagacgaactgtggctgcacc

SEQ ID NO: 548240 - DNA, 495 bp, Homo sapiens
  misc_feature: HIJSMM301CIS36.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactgggctcaggcgaagatgaggctgactattactgtaactcccgggccagcagtggtaacattgtgatattcggcggagggaccaaggtgaccgtcctacgtcagcccaaggctgccccctcggtcactctcg

SEQ ID NO: 548241 - DNA, 501 bp, Homo sapiens
  misc_feature: HIJSMM301BMFH1.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcagtgatcaccttcggccaagggacacgactggagattaaacg

SEQ ID NO: 548242 - DNA, 498 bp, Homo sapiens
  misc_feature: HIJSMM301DYY7C.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttatactgcatgcaagctctacaactcgaacgttcggccaagggaccaaggtggaaatcaaacgaactgtggctgcaccatctgtt

SEQ ID NO: 548243 - DNA, 505 bp, Homo sapiens; identical to SEQ ID NO: 536254
  misc_feature: HIJSMM301CZ1QI.7.71.G05.1.454.light.4.raw

SEQ ID NO: 548244 - DNA, 372 bp, Homo sapiens
  misc_feature: HIJSMM301DRL9S.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgcccctcggtcactctgttcccgccctcctccgagcgacga

SEQ ID NO: 548245 - DNA, 485 bp, Homo sapiens
  misc_feature: HIJSMM301EPMPL.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaagctgacgtcctaggtcacg

SEQ ID NO: 548246 - DNA, 482 bp, Homo sapiens
  misc_feature: HIJSMM301CV5VP.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaa

SEQ ID NO: 548247 - DNA, 505 bp, Homo sapiens
  misc_feature: HIJSMM301ADCGK.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaaggaccgaacggtagggatatctagacgaactagtggcgtgcg

SEQ ID NO: 548248 - DNA, 496 bp, Homo sapiens; identical to SEQ ID NO: 535109
  misc_feature: HIJSMM301BNQKE.16.78.H01.1.454.light.4.raw

SEQ ID NO: 548249 - DNA, 515 bp, Homo sapiens; identical to SEQ ID NO: 536247
  misc_feature: HIJSMM301CNQ0W.14.19.B08.1.454.light.4.raw

SEQ ID NO: 548250 - DNA, 486 bp, Homo sapiens; identical to SEQ ID NO: 535043
  misc_feature: HIJSMM301AQ8UM.46.35.D02.1.454.light.4.raw

SEQ ID NO: 548251 - DNA, 447 bp, Homo sapiens; identical to SEQ ID NO: 535020
  misc_feature: HIJSMM301CMSZF.18.9.A09.1.454.light.4.raw

SEQ ID NO: 548252 - DNA, 463 bp, Homo sapiens; identical to SEQ ID NO: 535062
  misc_feature: HIJSMM301BZ05J.11.73.G07.1.454.light.4.raw

SEQ ID NO: 548253 - DNA, 470 bp, Homo sapiens
  misc_feature: HIJSMM301B9ERK.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagatttgcaacttattactgtctacaagatcacaattatcctggacgttcggccaaggaccgaaggtggaaatacaacgaa

SEQ ID NO: 548254 - DNA, 511 bp, Homo sapiens
  misc_feature: HIJSMM301AV1YZ.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaagtggaagtcaagcgaactgtggctgcaccatctgtcttcatcttcccgcccact

SEQ ID NO: 548255 - DNA, 361 bp, Homo sapiens; identical to SEQ ID NO: 540413
  misc_feature: HIJSMM301BA9S7.3.57.F02.1.454.light.4.raw

SEQ ID NO: 548256 - DNA, 481 bp, Homo sapiens; identical to SEQ ID NO: 545917
  misc_feature: HIJSMM301BRA1J.52.5.A05.1.454.light.4.raw

SEQ ID NO: 548257 - DNA, 494 bp, Homo sapiens; identical to SEQ ID NO: 534992
  misc_feature: HIJSMM301EM5LH.9.1.A01.1.454.light.4.raw

SEQ ID NO: 548258 - DNA, 493 bp, Homo sapiens
  misc_feature: HIJSMM301C8RKI.43.55.E11.1.454.light.4.raw
tgtgagtagtcacgaccggtgctcgatttagcactcgcacgttgggtttggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaatacagacgaactgtggctgcaccatctgtcttcta

SEQ ID NO: 548259 - DNA, 513 bp, Homo sapiens; identical to SEQ ID NO: 535719
  misc_feature: HIJSMM301B36ZW.17.33.C11.1.454.light.4.raw

SEQ ID NO: 548260 - DNA, 504 bp, Homo sapiens; identical to SEQ ID NO: 535561
  misc_feature: HIJSMM301EN66Q.4.57.F02.1.454.light.4.raw

SEQ ID NO: 548261 - DNA, 505 bp, Homo sapiens
  misc_feature: HIJSMM301B4350.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaagatatgcttattggtaccatcagaagtcaggccaggcccctgtactggtcatctatgaggacaccaaacgaccctccgggatccctacgagattctctggctccagtttagggacagtggccaccctgacagtcagtgggcccaggtggaggatgagggtgattactactgttactcaacagacattactactactcatagggtgttcggcggagggaccaagctgaccgtcctaggtcagcccaaggctgccccctcggtcactctgttccc

SEQ ID NO: 548262 - DNA, 487 bp, Homo sapiens
  misc_feature: HIJSMM301EB5YJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccaggatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcggagatcagacgaactgtggctgcaccatctgtcttc

SEQ ID NO: 548263 - DNA, 499 bp, Homo sapiens
  misc_feature: HIJSMM301DTSUJ.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcacgtccccatgtgatcgttcgggccgggggaccaagctgaccgtcctaggtcagccc

SEQ ID NO: 548264 - DNA, 501 bp, Homo sapiens
  misc_feature: HIJSMM301EVGCM.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgccctcctcagacgtatca

SEQ ID NO: 548265 - DNA, 506 bp, Homo sapiens
  misc_feature: HIJSMM301EUAWS.8.28.C06.1.454.light.4.raw
ctcgcgtgtccacgaccggtgctcgatttagagctcacgtattgggtttgggggaggaactagctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 548266 - DNA, 513 bp, Homo sapiens
  misc_feature: HIJSMM301CFI4B.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcact

SEQ ID NO: 548267 - DNA, 514 bp, Homo sapiens; identical to SEQ ID NO: 545978
  misc_feature: HIJSMM301ASTHY.17.33.C11.1.454.light.4.raw

SEQ ID NO: 548268 - DNA, 494 bp, Homo sapiens; identical to SEQ ID NO: 539784
  misc_feature: HIJSMM301B4B24.22.57.F02.1.454.light.4.raw

SEQ ID NO: 548269 - DNA, 508 bp, Homo sapiens
  misc_feature: HIJSMM301AHSWN.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcacgtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcc

SEQ ID NO: 548270 - DNA, 444 bp, Homo sapiens
  misc_feature: HIJSMM301D497X.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcattctgttcccaccctcctccgtgtctgat

SEQ ID NO: 548271 - DNA, 498 bp, Homo sapiens; identical to SEQ ID NO: 536879
  misc_feature: HIJSMM301B8GLM.22.14.B03.1.454.light.4.raw

SEQ ID NO: 548272 - DNA, 504 bp, Homo sapiens; identical to SEQ ID NO: 537430
  misc_feature: HIJSMM301C7TSW.12.53.E09.1.454.light.4.raw

SEQ ID NO: 548273 - DNA, 487 bp, Homo sapiens; identical to SEQ ID NO: 536206
  misc_feature: HIJSMM301ASOP1.47.38.D05.1.454.light.4.raw

SEQ ID NO: 548274 - DNA, 495 bp, Homo sapiens; identical to SEQ ID NO: 535596
  misc_feature: HIJSMM301CYKAX.10.79.H02.1.454.light.4.raw

SEQ ID NO: 548275 - DNA, 508 bp, Homo sapiens
  misc_feature: HIJSMM301BKW8Y.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctgttcccacctcctcgctacgtaga

SEQ ID NO: 548276 - DNA, 487 bp, Homo sapiens; identical to SEQ ID NO: 539157
  misc_feature: HIJSMM301DPVOW.26.37.D04.1.454.light.4.raw

SEQ ID NO: 548277 - DNA, 492 bp, Homo sapiens; identical to SEQ ID NO: 537666
  misc_feature: HIJSMM301D8SIE.43.33.C11.1.454.light.4.raw

SEQ ID NO: 548278 - DNA, 493 bp, Homo sapiens
  misc_feature: HIJSMM301B1FD6.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgccaaggaccaaggtaggacgatcaaacgaactacgtggctgcaccatctgtctt

SEQ ID NO: 548279 - DNA, 527 bp, Homo sapiens
  misc_feature: HIJSMM301BZKE5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcacggacgaacggtaggaaggtacgaacgaaactaacgtggcgtgcgaccactactgtcttctactcttcccgtccctactcttcgtat

SEQ ID NO: 548280 - DNA, 497 bp, Homo sapiens; identical to SEQ ID NO: 544443
  misc_feature: HIJSMM301AZF0L.51.39.D06.1.454.light.4.raw

SEQ ID NO: 548281 - DNA, 471 bp, Homo sapiens
  misc_feature: HIJSMM301BRO7E.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaaggaccgaagtggaaatcaaacgaa

SEQ ID NO: 548282 - DNA, 499 bp, Homo sapiens
  misc_feature: HIJSMM301COZ0U.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttccca

SEQ ID NO: 548283 - DNA, 487 bp, Homo sapiens; identical to SEQ ID NO: 536206
  misc_feature: HIJSMM301EGB9J.47.38.D05.1.454.light.4.raw

SEQ ID NO: 548284 - DNA, 503 bp, Homo sapiens; identical to SEQ ID NO: 540665
  misc_feature: HIJSMM301BN3YJ.4.57.F02.1.454.light.4.raw

SEQ ID NO: 548285 - DNA, 494 bp, Homo sapiens; identical to SEQ ID NO: 534992
  misc_feature: HIJSMM301CV6U4.9.1.A01.1.454.light.4.raw

SEQ ID NO: 548286 - DNA, 509 bp, Homo sapiens
  misc_feature: HIJSMM301AF8K3.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcccgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 548287 - DNA, 501 bp, Homo sapiens; identical to SEQ ID NO: 535746
  misc_feature: HIJSMM301CQ9E5.18.11.A11.1.454.light.4.raw

SEQ ID NO: 548288 - DNA, 498 bp, Homo sapiens
  misc_feature: HIJSMM301DHLEZ.48.29.C07.1.454.light.4.raw
agtatacatacacgaccggtgctcgatttagagtgctacgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaacgaactgtggctgcaccatctgtcttcatcttcccgcc

SEQ ID NO: 548289 - DNA, 504 bp, Homo sapiens
  misc_feature: HIJSMM301A0P5O.19.78.H01.1.454.light.4.raw
  modified_base (499)..(499): a, c, t, g, unknown or other
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtccgtgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccntgtca

SEQ ID NO: 548290 - DNA, 473 bp, Homo sapiens; identical to SEQ ID NO: 541472
  misc_feature: HIJSMM301D6ESS.5.12.B01.1.454.light.4.raw

SEQ ID NO: 548291 - DNA, 489 bp, Homo sapiens
  misc_feature: HIJSMM301EM26H.17.35.D02.1.454.light.4.raw
cgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccacgatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtctt

SEQ ID NO: 548292 - DNA, 494 bp, Homo sapiens; identical to SEQ ID NO: 534992
  misc_feature: HIJSMM301ETLBF.9.1.A01.1.454.light.4.raw

SEQ ID NO: 548293 - DNA, 495 bp, Homo sapiens; identical to SEQ ID NO: 536055
  misc_feature: HIJSMM301C5NMI.47.38.D05.1.454.light.4.raw

SEQ ID NO: 548294 - DNA, 487 bp, Homo sapiens
  misc_feature: HIJSMM301ANPEF.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggtccaggggaccgaaggtcgaaatagagacgaactgtggctgcaccatctgtctt

SEQ ID NO: 548295 - DNA, 473 bp, Homo sapiens; identical to SEQ ID NO: 538875
  misc_feature: HIJSMM301BILN6.4.75.G09.1.454.light.4.raw

SEQ ID NO: 548296 - DNA, 491 bp, Homo sapiens
  misc_feature: HIJSMM301BY42I.52.81.H04.1.454.light.4.raw
cgcagtacgacacgaccggtgctcgatttagtagtgtagattcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggtca

SEQ ID NO: 548297 - DNA, 519 bp, Homo sapiens
  misc_feature: HIJSMM301EQEQW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacggaccgaacggtaggaaggtacgaaacgaactagtggcgtgcgaccactactcgtcttctatcttcccgccact

SEQ ID NO: 548298 - DNA, 505 bp, Homo sapiens
  misc_feature: HIJSMM301B02SX.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaaacgaactgtggctgcaccatctgtcttcta

SEQ ID NO: 548299 - DNA, 507 bp, Homo sapiens
  misc_feature: HIJSMM301BEL2J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaacctagtggctgcaccatctgtcttctatcttccccg

SEQ ID NO: 548300 - DNA, 504 bp, Homo sapiens; identical to SEQ ID NO: 536385
  misc_feature: HIJSMM301BXQXY.27.78.H01.1.454.light.4.raw

SEQ ID NO: 548301 - DNA, 506 bp, Homo sapiens; identical to SEQ ID NO: 540259
  misc_feature: HIJSMM301A3ZN4.15.5.A05.1.454.light.4.raw

SEQ ID NO: 548302 - DNA, 497 bp, Homo sapiens
  misc_feature: HIJSMM301EJJWL.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattacttgtcagcaatatggtaggtcacctgggacttttggtccaggggaccaagctggagatcaaacgaactgtggctgcaccatctgtctt

SEQ ID NO: 548303 - DNA, 497 bp, Homo sapiens
  misc_feature: HIJSMM301CJKEF.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcaatttattattgtcagcaatattatattcctcctcagacgttcggccaagggaccaaggtggaaatcaaacgaactgtggctgcacca

SEQ ID NO: 548304 - DNA, 499 bp, Homo sapiens
  misc_feature: HIJSMM301CK7FD.48.41.D08.1.454.light.4.raw
agtatacatacacgaccggtgctcgatttagtcacgcgagaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttcccg

SEQ ID NO: 548305 - DNA, 482 bp, Homo sapiens
  misc_feature: HIJSMM301CJ1A3.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcgagggaccaagctgaccgtcctaggtcagcccaaggctgccccctggtca

SEQ ID NO: 548306 - DNA, 505 bp, Homo sapiens; identical to SEQ ID NO: 539292
  misc_feature: HIJSMM301AFTZB.19.85.H08.1.454.light.4.raw

SEQ ID NO: 548307 - DNA, 505 bp, Homo sapiens; identical to SEQ ID NO: 535503
  misc_feature: HIJSMM301DGB3S.8.28.C06.1.454.light.4.raw

SEQ ID NO: 548308 - DNA, 500 bp, Homo sapiens
  misc_feature: HIJSMM301DMMEH.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccta

SEQ ID NO: 548309 - DNA, 505 bp, Homo sapiens
  misc_feature: HIJSMM301EKK91.8.28.C06.1.454.light.4.raw
ctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttca

SEQ ID NO: 548310 - DNA, 496 bp, Homo sapiens
  misc_feature: HIJSMM301ADIPM.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctcccccctactaacttcgttcgagggaccgagtagaacatacatacgactagtggctcgcaccta

SEQ ID NO: 548311 - DNA, 494 bp, Homo sapiens; identical to SEQ ID NO: 534992
  misc_feature: HIJSMM301DDTCB.9.1.A01.1.454.light.4.raw

SEQ ID NO: 548312 - DNA, 502 bp, Homo sapiens; identical to SEQ ID NO: 543695
  misc_feature: HIJSMM301BCW8P.19.78.H01.1.454.light.4.raw

SEQ ID NO: 548313 - DNA, 486 bp, Homo sapiens
  misc_feature: HIJSMM301DNMM8.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccggtggaggctgaggacgttggaatttattactgtatgcaaggtatagagcttcctccgacgttcggccaagggaccaaggtggaactcaaacgaa

SEQ ID NO: 548314 - DNA, 494 bp, Homo sapiens; identical to SEQ ID NO: 535276
  misc_feature: HIJSMM301ASANA.16.6.A06.1.454.light.4.raw

SEQ ID NO: 548315 - DNA, 494 bp, Homo sapiens; identical to SEQ ID NO: 534994
  misc_feature: HIJSMM301A44XJ.27.78.H01.1.454.light.4.raw

SEQ ID NO: 548316 - DNA, 516 bp, Homo sapiens
  misc_feature: HIJSMM301AFSEA.41.55.E11.1.454.light.4.raw
tctatactatcacgaccggtgctcgatttagcactcgcacgttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccg

SEQ ID NO: 548317 - DNA, 477 bp, Homo sapiens
  misc_feature: HIJSMM301DUKL3.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccccgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaactgtggctgca

SEQ ID NO: 548318 - DNA, 486 bp, Homo sapiens; identical to SEQ ID NO: 537583
  misc_feature: HIJSMM301ECSOA.17.25.C03.1.454.light.4.raw

SEQ ID NO: 548319 - DNA, 444 bp, Homo sapiens; identical to SEQ ID NO: 535856
  misc_feature: HIJSMM301B9JLP.9.9.A09.1.454.light.4.raw

SEQ ID NO: 548320 - DNA, 504 bp, Homo sapiens; identical to SEQ ID NO: 538940
  misc_feature: HIJSMM301AU76E.2.35.D02.1.454.light.4.raw

SEQ ID NO: 548321 - DNA, 504 bp, Homo sapiens; identical to SEQ ID NO: 539083
  misc_feature: HIJSMM301DTOM2.8.19.B08.1.454.light.4.raw

SEQ ID NO: 548322 - DNA, 502 bp, Homo sapiens
  misc_feature: HIJSMM301BZ8C4.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgattttactgcggaacatgggataccagcctgcatggtgtggttttcggcggagggaccaagctgaccgtcctaagtcagcccaaggctgccccc

SEQ ID NO: 548323 - DNA, 494 bp, Homo sapiens
  misc_feature: HIJSMM301B3N6E.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcaggacacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 548324 - DNA, 484 bp, Homo sapiens; identical to SEQ ID NO: 535400
  misc_feature: HIJSMM301CLN6N.46.26.C04.1.454.light.4.raw

SEQ ID NO: 548325 - DNA, 454 bp, Homo sapiens; identical to SEQ ID NO: 535005
  misc_feature: HIJSMM301A8J2U.19.86.H09.1.454.light.4.raw

SEQ ID NO: 548326 - DNA, 492 bp, Homo sapiens; identical to SEQ ID NO: 534967
  misc_feature: HIJSMM301BE3BY.47.64.F09.1.454.light.4.raw

SEQ ID NO: 548327 - DNA, 486 bp, Homo sapiens; identical to SEQ ID NO: 535043
  misc_feature: HIJSMM301CV4M1.46.35.D02.1.454.light.4.raw

SEQ ID NO: 548328 - DNA, 480 bp, Homo sapiens
  misc_feature: HIJSMM301DNWQR.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagttagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 548329 - DNA, 484 bp, Homo sapiens
  misc_feature: HIJSMM301AP89G.3.14.B03.1.454.light.4.raw
agacgcactccacgaccggtgctcgatttagtgtgagtagttccgcggggacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagcccagccagcaataagaactacttaggttggtagcagcagaatccaggacagcctcctaagctgctcatttactgggcatctacccgggaatccggggtccctgaccgattcagtggcggcgggtctgggacagatttcactctcaccatcagcagcctgcaggctgctgaagtggcagctcattactgtcagcaatattatagtcctcctgtgaagtttggtccaggggaccaagactggagatcaaacgaaactagtggctgcaccatctgtctt

SEQ ID NO: 548330 - DNA, 479 bp, Homo sapiens; identical to SEQ ID NO: 535531
  misc_feature: HIJSMM301EXHT2.41.17.B06.1.454.light.4.raw

SEQ ID NO: 548331 - DNA, 512 bp, Homo sapiens
  misc_feature: HIJSMM301AXK6H.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctacttggtggtgctgtgctattcggcggagggaccgaagctgaccgtcttaagtcagcccaaggctgccccctcggtcactctgttcccgccctcct

SEQ ID NO: 548332 - DNA, 466 bp, Homo sapiens
  misc_feature: HIJSMM301CKOLY.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttattttcaccatcagcagcctgcagcctgaagatattgcaacatattactgtcagcagtatgataatctcccgatcaccttcggccaagggacacgactggagattaaacgaa

SEQ ID NO: 548333 - DNA, 507 bp, Homo sapiens
  misc_feature: HIJSMM301EDML2.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctcg

SEQ ID NO: 548334 - DNA, 504 bp, Homo sapiens; identical to SEQ ID NO: 538423
  misc_feature: HIJSMM301CM7AB.48.67.G01.1.454.light.4.raw

SEQ ID NO: 548335 - DNA, 500 bp, Homo sapiens
  misc_feature: HIJSMM301EW0R6.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 548336 - DNA, 494 bp, Homo sapiens; identical to SEQ ID NO: 534994
  misc_feature: HIJSMM301B7284.27.78.H01.1.454.light.4.raw

SEQ ID NO: 548337 - DNA, 484 bp, Homo sapiens; identical to SEQ ID NO: 542211
  misc_feature: HIJSMM301AX516.13.36.D03.1.454.light.4.raw

SEQ ID NO: 548338 - DNA, 489 bp, Homo sapiens; identical to SEQ ID NO: 546040
  misc_feature: HIJSMM301CZ2RA.11.12.B01.1.454.light.4.raw

SEQ ID NO: 548339 - DNA, 489 bp, Homo sapiens
  misc_feature: HIJSMM301DSLZ6.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagccc

SEQ ID NO: 548340 - DNA, 486 bp, Homo sapiens; identical to SEQ ID NO: 537617
  misc_feature: HIJSMM301BAHAT.10.53.E09.1.454.light.4.raw

SEQ ID NO: 548341 - DNA, 471 bp, Homo sapiens
  misc_feature: HIJSMM301ECLKA.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaa

SEQ ID NO: 548342 - DNA, 493 bp, Homo sapiens
  misc_feature: HIJSMM301AU0CC.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagattaaacgaactgtggctgcaccatctgtctt

SEQ ID NO: 548343 - DNA, 487 bp, Homo sapiens
  misc_feature: HIJSMM301BOFLJ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatcaacgaa

SEQ ID NO: 548344 - DNA, 501 bp, Homo sapiens; identical to SEQ ID NO: 537545
  misc_feature: HIJSMM301BOKQ6.49.69.G03.1.454.light.4.raw

SEQ ID NO: 548345 - DNA, 415 bp, Homo sapiens
  misc_feature: HIJSMM301ARTJE.40.36.D03.1.454.light.4.raw
tctagcgactcacgaccggtgctcgatttagctgcgtcacgatctctcttgggagttacccgattggagggcgttatccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatctgtcttcatcttcccgccatctgaagtcgctaga

SEQ ID NO: 548346 - DNA, 486 bp, Homo sapiens; identical to SEQ ID NO: 535523
  misc_feature: HIJSMM301BBP61.22.73.G07.1.454.light.4.raw

SEQ ID NO: 548347 - DNA, 487 bp, Homo sapiens; identical to SEQ ID NO: 538190
  misc_feature: HIJSMM301CWPUD.47.70.G04.1.454.light.4.raw

SEQ ID NO: 548348 - DNA, 501 bp, Homo sapiens
  misc_feature: HIJSMM301EBNEG.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactctgttcccc

SEQ ID NO: 548349 - DNA, 496 bp, Homo sapiens
  misc_feature: HIJSMM301CMST0.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatattttctatcctcgtggacgttgccaaggaccaggtggaaatcagacgaactgtggctgcaccat

SEQ ID NO: 548350 - DNA, 500 bp, Homo sapiens; identical to SEQ ID NO: 535310
  misc_feature: HIJSMM301CH4EV.47.66.F11.1.454.light.4.raw

SEQ ID NO: 548351 - DNA, 454 bp, Homo sapiens; identical to SEQ ID NO: 534964
  misc_feature: HIJSMM301DST0C.19.86.H09.1.454.light.4.raw

SEQ ID NO: 548352 - DNA, 494 bp, Homo sapiens; identical to SEQ ID NO: 534992
  misc_feature: HIJSMM301AZDSY.9.1.A01.1.454.light.4.raw

SEQ ID NO: 548353 - DNA, 480 bp, Homo sapiens; identical to SEQ ID NO: 535291
  misc_feature: HIJSMM301B2UD0.22.59.F04.1.454.light.4.raw

SEQ ID NO: 548354 - DNA, 485 bp, Homo sapiens; identical to SEQ ID NO: 538053
  misc_feature: HIJSMM301CYMIB.13.5.A05.1.454.light.4.raw

SEQ ID NO: 548355 - DNA, 485 bp, Homo sapiens
  misc_feature: HIJSMM301BVPFY.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtgggatctagggcagatttcactctcaccatcaatcacctgcaggctgaggattttgcaacttactactgtcagcaggctaacaggctgcccccaaccttcggccagggacacgactggagattaaacgaactgtggctgcaccatctgt

SEQ ID NO: 548356 - DNA, 507 bp, Homo sapiens; identical to SEQ ID NO: 538702
  misc_feature: HIJSMM301AGETG.11.57.F02.1.454.light.4.raw

SEQ ID NO: 548357 - DNA, 501 bp, Homo sapiens
  misc_feature: HIJSMM301AYS04.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 548358 - DNA, 506 bp, Homo sapiens
  misc_feature: HIJSMM301ECL5G.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaatacaaacgaactagtggctgcaccatctgtcttcatcttccccg

SEQ ID NO: 548359 - DNA, 492 bp, Homo sapiens; identical to SEQ ID NO: 544239
  misc_feature: HIJSMM301DDYM2.13.39.D06.1.454.light.4.raw

SEQ ID NO: 548360 - DNA, 422 bp, Homo sapiens; identical to SEQ ID NO: 537797
  misc_feature: HIJSMM301C6OKN.9.34.D01.1.454.light.4.raw

SEQ ID NO: 548361 - DNA, 493 bp, Homo sapiens; identical to SEQ ID NO: 535047
  misc_feature: HIJSMM301BHXB0.16.53.E09.1.454.light.4.raw

SEQ ID NO: 548362 - DNA, 517 bp, Homo sapiens
  misc_feature: HIJSMM301BASUS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggtccaacgggaccgaacggtaggaaagtacaaaacgaactagtggcgtgcaccactctgttcttctactcttccccg

SEQ ID NO: 548363 - DNA, 383 bp, Homo sapiens; identical to SEQ ID NO: 540698
  misc_feature: HIJSMM301COZUX.41.28.C06.1.454.light.4.raw

SEQ ID NO: 548364 - DNA, 501 bp, Homo sapiens
  misc_feature: HIJSMM301B7SL1.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaacgaactgtggctgcaccatctgt

SEQ ID NO: 548365 - DNA, 504 bp, Homo sapiens
  misc_feature: HIJSMM301EH0CY.49.15.B04.1.454.light.4.raw
agtcgagagacacgaccggtgctcgatttagacagtatatatccgcgggcacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgt

SEQ ID NO: 548366 - DNA, 484 bp, Homo sapiens; identical to SEQ ID NO: 535400
  misc_feature: HIJSMM301D2Z8O.46.26.C04.1.454.light.4.raw

SEQ ID NO: 548367 - DNA, 494 bp, Homo sapiens; identical to SEQ ID NO: 534994
  misc_feature: HIJSMM301B2SUI.27.78.H01.1.454.light.4.raw

SEQ ID NO: 548368 - DNA, 494 bp, Homo sapiens; identical to SEQ ID NO: 539894
  misc_feature: HIJSMM301AJ6I1.16.53.E09.1.454.light.4.raw

SEQ ID NO: 548369 - DNA, 468 bp, Homo sapiens
  misc_feature: HIJSMM301ASCC7.51.87.H10.1.454.light.4.raw
cgatcgtatacacgaccggtgctcgatttagcagtactgcgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggaccgaaggtggagatc

SEQ ID NO: 548370 - DNA, 514 bp, Homo sapiens
  misc_feature: HIJSMM301C3A7R.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcaacccaaggctgccccctcggtcactctgttctcgccctcctc

SEQ ID NO: 548371 - DNA, 454 bp, Homo sapiens; identical to SEQ ID NO: 534964
  misc_feature: HIJSMM301C48F5.19.86.H09.1.454.light.4.raw

SEQ ID NO: 548372 - DNA, 512 bp, Homo sapiens
  misc_feature: HIJSMM301ARXP9.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatccattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggtcggagggaccaagttgaccgccctaggtcagcccaaggctgtccccccg

SEQ ID NO: 548373 - DNA, 497 bp, Homo sapiens; identical to SEQ ID NO: 536371
  misc_feature: HIJSMM301EA47S.16.78.H01.1.454.light.4.raw

SEQ ID NO: 548374 - DNA, 462 bp, Homo sapiens
  misc_feature: HIJSMM301B5BUJ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttggggtgttcggcggagggaccagggctgaccgtcctaggtcagcccaaggctgccccctcggtcactctgttcccaccctcctcacgcgtatgt

SEQ ID NO: 548375 - DNA, 497 bp, Homo sapiens; identical to SEQ ID NO: 535764
  misc_feature: HIJSMM301A7R80.22.20.B09.1.454.light.4.raw

SEQ ID NO: 548376 - DNA, 487 bp, Homo sapiens; identical to SEQ ID NO: 537208
  misc_feature: HIJSMM301AUIG6.3.55.E11.1.454.light.4.raw

SEQ ID NO: 548377 - DNA, 488 bp, Homo sapiens; identical to SEQ ID NO: 537055
  misc_feature: HIJSMM301AU5Q6.4.64.F09.1.454.light.4.raw

SEQ ID NO: 548378 - DNA, 492 bp, Homo sapiens
  misc_feature: HIJSMM301EMH8G.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactgtggctgcacatct

SEQ ID NO: 548379 - DNA, 503 bp, Homo sapiens; identical to SEQ ID NO: 538884
  misc_feature: HIJSMM301BIN8M.27.78.H01.1.454.light.4.raw

SEQ ID NO: 548380 - DNA, 495 bp, Homo sapiens; identical to SEQ ID NO: 535964
  misc_feature: HIJSMM301C9X0U.16.10.A10.1.454.light.4.raw

SEQ ID NO: 548381 - DNA, 487 bp, Homo sapiens
  misc_feature: HIJSMM301DFZE2.9.75.G09.1.454.light.4.raw
tgatacgtctcacgaccggtgctcgatttagtatagacatcagggggagtcagacccagtcaggacacagcgtggacatgagggtccctgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtcttcta

SEQ ID NO: 548382 - DNA, 494 bp, Homo sapiens
  misc_feature: HIJSMM301CL7NE.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtaggaggatcaaacgaacta

SEQ ID NO: 548383 - DNA, 455 bp, Homo sapiens
  misc_feature: HIJSMM301CXX39.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacggagagta

SEQ ID NO: 548384 - DNA, 494 bp, Homo sapiens; identical to SEQ ID NO: 535276
  misc_feature: HIJSMM301CTR6G.16.6.A06.1.454.light.4.raw

SEQ ID NO: 548385 - DNA, 485 bp, Homo sapiens
  misc_feature: HIJSMM301ENN6Y.4.57.F02.1.454.light.4.raw
agcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaaactgtggctgcacc

SEQ ID NO: 548386 - DNA, 492 bp, Homo sapiens; identical to SEQ ID NO: 537666
  misc_feature: HIJSMM301DDDSK.43.33.C11.1.454.light.4.raw

SEQ ID NO: 548387 - DNA, 474 bp, Homo sapiens
  misc_feature: HIJSMM301CA8I7.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctagtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 548388 - DNA, 484 bp, Homo sapiens; identical to SEQ ID NO: 535240
  misc_feature: HIJSMM301BCEJE.47.60.F05.1.454.light.4.raw

SEQ ID NO: 548389 - DNA, 499 bp, Homo sapiens
  misc_feature: HIJSMM301B629K.49.43.D10.1.454.light.4.raw
agtcgagagacacgaccggtgctcgatttagactagcagtaaggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggactcccgggcagagggtcaccatctcttgttctggaggcagctccaacatcggaagtaatgatgttaactggtaccaacaaattccagggacggcccccaatgtcttcatctttggtaatgatcagcggccctcaggggtccctgaccgattctctggctccaagtctggcacctcagcctccctggccatcagtgggctccagtctgaggatgaggctgattattactgtgcaacatgggatgacagcctgaatgccgtggttttcggcggagggaccaaggtgaccgtcctaggtcagcccaaggctcg

SEQ ID NO: 548390 - DNA, 485 bp, Homo sapiens; identical to SEQ ID NO: 535653
  misc_feature: HIJSMM301D12FZ.47.62.F07.1.454.light.4.raw

SEQ ID NO: 548391 - DNA, 506 bp, Homo sapiens
  misc_feature: HIJSMM301BKZIE.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaacggctgccccctccggtcgactcttcg

SEQ ID NO: 548392 - DNA, 511 bp, Homo sapiens
  misc_feature: HIJSMM301CAWRD.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaggaccgaaggtggcaatcaaccgaactgtggctgcaccatctgtcttcatcttcccgccatctgagacacgcg

SEQ ID NO: 548393 - DNA, 445 bp, Homo sapiens; identical to SEQ ID NO: 537719
  misc_feature: HIJSMM301AHGJZ.47.85.H08.1.454.light.4.raw

SEQ ID NO: 548394 - DNA, 496 bp, Homo sapiens; identical to SEQ ID NO: 535109
  misc_feature: HIJSMM301BT9KB.16.78.H01.1.454.light.4.raw

SEQ ID NO: 548395 - DNA, 488 bp, Homo sapiens
  misc_feature: HIJSMM301A4ICW.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtaggtggaggctgaggatgttggggtttattactgcatgcaagttctacaaacttcctactacttttggccaggggaccaagctggagatcaaacgaa

SEQ ID NO: 548396 - DNA, 493 bp, Homo sapiens; identical to SEQ ID NO: 535047
  misc_feature: HIJSMM301A2B6Q.16.53.E09.1.454.light.4.raw

SEQ ID NO: 548397 - DNA, 503 bp, Homo sapiens; identical to SEQ ID NO: 538884
  misc_feature: HIJSMM301CTSW0.27.78.H01.1.454.light.4.raw

SEQ ID NO: 548398 - DNA, 500 bp, Homo sapiens
  misc_feature: HIJSMM301B20Z4.17.27.C05.1.454.light.4.raw
cgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcgaagatgaggctgactattactgtaactcccgggacagcagtgctgaccaggtggtattcggcggagggacccacctgaccgtcttaggtcagcccaaggctgccccctcggtc

SEQ ID NO: 548399 - DNA, 498 bp, Homo sapiens
  misc_feature: HIJSMM301DXJ2R.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgaccgtcctaggtcagcccaaggctgccccctcggtcactc

SEQ ID NO: 548400 - DNA, 485 bp, Homo sapiens
  misc_feature: HIJSMM301B3DEZ.8.49.E05.1.454.light.4.raw
ctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaacgcccccaaactcctgatcaattatgcatccagtttgcaaagtgggtcccatcaagattcagtggcggtggatcgtgggacagtatttcactctcaccatcaacagtctgcagattgaggtattatgctaacttattactgtcagacagacgttccacggaccccgctctacgtttccgggcggggaccgaagtggacgtacaaacgaa

SEQ ID NO: 548401 - DNA, 494 bp, Homo sapiens; identical to SEQ ID NO: 534992
  misc_feature: HIJSMM301B3WRB.9.1.A01.1.454.light.4.raw

SEQ ID NO: 548402 - DNA, 459 bp, Homo sapiens
  misc_feature: HIJSMM301BMDX1.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgatctctcg

SEQ ID NO: 548403 - DNA, 447 bp, Homo sapiens; identical to SEQ ID NO: 535020
  misc_feature: HIJSMM301CQKET.18.9.A09.1.454.light.4.raw

SEQ ID NO: 548404 - DNA, 470 bp, Homo sapiens
  misc_feature: HIJSMM301D3IXY.49.57.F02.1.454.light.4.raw
agtcgagagacacgaccggtgctcgatttagctcgatatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtgg

SEQ ID NO: 548405 - DNA, 491 bp, Homo sapiens; identical to SEQ ID NO: 535176
  misc_feature: HIJSMM301D5BFO.13.39.D06.1.454.light.4.raw

SEQ ID NO: 548406 - DNA, 490 bp, Homo sapiens
  misc_feature: HIJSMM301BEGXZ.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtctt

SEQ ID NO: 548407 - DNA, 504 bp, Homo sapiens
  misc_feature: HIJSMM301ASO65.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgtcactaagcggccctcaggggtttctaatcgcttctctggctccaagtctggcaacacggcctccctgacaatctctgggctccaggctgagggacgaggctgattactactgctgctcatatgcaggtcgtatctcttatgtcttcggaactgggaccaaggtcaccgtcctaggtcagcccaaggccaaacccactgtca

SEQ ID NO: 548408 - DNA, 488 bp, Homo sapiens
  misc_feature: HIJSMM301EDKCT.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactacttgtcaacagagttacagtacccccctcactttcggcggagggaccaaggcggagatcagacgaactgtggctgcaccatctgtcttc

SEQ ID NO: 548409 - DNA, 503 bp, Homo sapiens
  misc_feature: HIJSMM301CK36O.18.37.D04.1.454.light.4.raw
  modified_base (497)..(497): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcnccatct

SEQ ID NO: 548410 - DNA, 471 bp, Homo sapiens
  misc_feature: HIJSMM301D8QJO.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacttggccaagggaccaaggtggaaatcaaacgaa

SEQ ID NO: 548411 - DNA, 486 bp, Homo sapiens
  misc_feature: HIJSMM301DDFNW.46.35.D02.1.454.light.4.raw
  modified_base (473)..(473): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctatttactgtcagcagtatggtcacgtcccaagaacttttggccaggggaccaagctggagatcaacgaacngtggctgcaccat

SEQ ID NO: 548412 - DNA, 496 bp, Homo sapiens
  misc_feature: HIJSMM301DCMDF.43.55.E11.1.454.light.4.raw
tgtgagtagtcacgaccggtgctcgatttagcactcgcacgttgggtttggggagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaactgtggctgcaccatctgtcttcatcttcccg

SEQ ID NO: 548413 - DNA, 489 bp, Homo sapiens; identical to SEQ ID NO: 536663
  misc_feature: HIJSMM301BNVEL.16.72.G06.1.454.light.4.raw

SEQ ID NO: 548414 - DNA, 488 bp, Homo sapiens
  misc_feature: HIJSMM301EPB0D.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcgtagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctgagatcaaacgaactgtggctgcacca

SEQ ID NO: 548415 - DNA, 486 bp, Homo sapiens; identical to SEQ ID NO: 535385
  misc_feature: HIJSMM301CBTDC.19.71.G05.1.454.light.4.raw

SEQ ID NO: 548416 - DNA, 448 bp, Homo sapiens; identical to SEQ ID NO: 538417
  misc_feature: HIJSMM301D4EZ1.18.9.A09.1.454.light.4.raw

SEQ ID NO: 548417 - DNA, 494 bp, Homo sapiens
  misc_feature: HIJSMM301AW9HH.52.45.E01.1.454.light.4.raw
cgcagtacgacacgaccggtgctcgatttagtgagtcagtaagggaaaggggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacacgcccccaaactcctcatctttggtaacagcaatcggccctccgggtccctgaccgattctctggctccaagtctggcacctcagcctccctggcccatcactgggcctccaggctgaggatgaggctgattattactgccagtcctatgacagcagcctgagtgtctttgggtcttcggaactgggaccaggtcaccgtc

SEQ ID NO: 548418 - DNA, 503 bp, Homo sapiens
  misc_feature: HIJSMM301CUN6T.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaaccgaacggtggaaatacaaacgaaactagtggctgcaccatctgtcttctatcttcccgccat

SEQ ID NO: 548419 - DNA, 513 bp, Homo sapiens; identical to SEQ ID NO: 535244
  misc_feature: HIJSMM301A3GKH.17.33.C11.1.454.light.4.raw

SEQ ID NO: 548420 - DNA, 509 bp, Homo sapiens
  misc_feature: HIJSMM301ER0PU.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccgggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcatt

SEQ ID NO: 548421 - DNA, 515 bp, Homo sapiens
  misc_feature: HIJSMM301DF4JU.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctca

SEQ ID NO: 548422 - DNA, 512 bp, Homo sapiens
  misc_feature: HIJSMM301C1V2B.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatgtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggtcggaggcaccgaagtgaccgtcctcggtcagccaaggctgccccctcggtcact

SEQ ID NO: 548423 - DNA, 472 bp, Homo sapiens
  misc_feature: HIJSMM301CNMXS.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtgggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacg

SEQ ID NO: 548424 - DNA, 498 bp, Homo sapiens; identical to SEQ ID NO: 546411
  misc_feature: HIJSMM301BI2G7.48.59.F04.1.454.light.4.raw

SEQ ID NO: 548425 - DNA, 495 bp, Homo sapiens; identical to SEQ ID NO: 538673
  misc_feature: HIJSMM301BZ3OX.51.35.D02.1.454.light.4.raw

SEQ ID NO: 548426 - DNA, 484 bp, Homo sapiens; identical to SEQ ID NO: 535400
  misc_feature: HIJSMM301DE4M9.46.26.C04.1.454.light.4.raw

SEQ ID NO: 548427 - DNA, 494 bp, Homo sapiens; identical to SEQ ID NO: 534992
  misc_feature: HIJSMM301EWHAC.9.1.A01.1.454.light.4.raw

SEQ ID NO: 548428 - DNA, 494 bp, Homo sapiens
  misc_feature: HIJSMM301DX4RL.48.27.C05.1.454.light.4.raw
agtatacatacacgaccggtgctcgatttagacgcgatcgaagggtttgggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccatctgatatgta

SEQ ID NO: 548429 - DNA, 487 bp, Homo sapiens
  misc_feature: HIJSMM301EGTGA.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtgctgcaccatctgtt

SEQ ID NO: 548430 - DNA, 487 bp, Homo sapiens; identical to SEQ ID NO: 537079
  misc_feature: HIJSMM301AQPMR.14.55.E11.1.454.light.4.raw

SEQ ID NO: 548431 - DNA, 486 bp, Homo sapiens; identical to SEQ ID NO: 535458
  misc_feature: HIJSMM301ATJJ4.7.75.G09.1.454.light.4.raw

SEQ ID NO: 548432 - DNA, 485 bp, Homo sapiens; identical to SEQ ID NO: 538533
  misc_feature: HIJSMM301ALRKZ.47.78.H01.1.454.light.4.raw

SEQ ID NO: 548433 - DNA, 489 bp, Homo sapiens
  misc_feature: HIJSMM301ATBDR.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaacggacacgactggagattaaacgaactgtggctgcaccatctgtcttcat

SEQ ID NO: 548434 - DNA, 488 bp, Homo sapiens; identical to SEQ ID NO: 537124
  misc_feature: HIJSMM301EJOTZ.11.25.C03.1.454.light.4.raw

SEQ ID NO: 548435 - DNA, 511 bp, Homo sapiens
  misc_feature: HIJSMM301AS4XK.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggagagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatt

SEQ ID NO: 548436 - DNA, 489 bp, Homo sapiens
  misc_feature: HIJSMM301B5TGG.41.2.A02.1.454.light.4.raw
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttcccg

SEQ ID NO: 548437 - DNA, 494 bp, Homo sapiens; identical to SEQ ID NO: 539006
  misc_feature: HIJSMM301DLV1Z.48.1.A01.1.454.light.4.raw

SEQ ID NO: 548438 - DNA, 514 bp, Homo sapiens; identical to SEQ ID NO: 544242
  misc_feature: HIJSMM301AOV3K.43.23.C01.1.454.light.4.raw

SEQ ID NO: 548439 - DNA, 511 bp, Homo sapiens
  misc_feature: HIJSMM301CXYH2.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctcg

SEQ ID NO: 548440 - DNA, 495 bp, Homo sapiens
  misc_feature: HIJSMM301E1EIX.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggacggaccacagtcgagataccaaacgaaccgtgtggcgtcgcaccatcttcg

SEQ ID NO: 548441 - DNA, 486 bp, Homo sapiens; identical to SEQ ID NO: 541163
  misc_feature: HIJSMM301AT6MC.19.57.F02.1.454.light.4.raw

SEQ ID NO: 548442 - DNA, 521 bp, Homo sapiens; identical to SEQ ID NO: 539470
  misc_feature: HIJSMM301B2UFB.27.23.C01.1.454.light.4.raw

SEQ ID NO: 548443 - DNA, 513 bp, Homo sapiens
  misc_feature: HIJSMM301DJD9S.51.35.D02.1.454.light.4.raw
cgatcgtatacacgaccggtgctcgatttagcacacgatagttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataaatcgacagggtggaggctgaggatgttgggttttattactgcatgcaaggtacacactggcctggggacgttcggccaagggaccgaaggtggaaatacaacgaaactgtggctgcaccatctgtcttctat

SEQ ID NO: 548444 - DNA, 453 bp, Homo sapiens; identical to SEQ ID NO: 544521
  misc_feature: HIJSMM301CWU9Q.19.86.H09.1.454.light.4.raw

SEQ ID NO: 548445 - DNA, 501 bp, Homo sapiens
  misc_feature: HIJSMM301CHGUV.52.57.F02.1.454.light.4.raw
cgcagtacgacacgaccggtgctcgatttagctcgatatagttgggtttgggggaggaactactcagttaggacccagacggaaccatggaagccccagcgcagcttctcttcctcctgctactctggctcccagatacccccgaatagattgtgttgacacagtctccagccaccctgtctttgtctccaggggaaagagccaccctctcctgcagggccagtcagggtgttaacagctactttccctggtaccgccagagacctggccaggctcccagactcctcatctctgatgcatctacttgggccactggcgtcccagccaggttcagtggcagtgggcctgggacagtcttcactctcgtcatcagcagcctagagcctgaagactttgcgctttattactgtcagcagtgttgcaactggcatttcggcggagggaccaaggtggagatcaaacgcaggaactgtggctgcaccatctgtcttcatcttcccg

SEQ ID NO: 548446 - DNA, 497 bp, Homo sapiens
  misc_feature: HIJSMM301AR19E.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtccactctgttcccgccctcctcgagtgcgtct

SEQ ID NO: 548447 - DNA, 487 bp, Homo sapiens
  misc_feature: HIJSMM301D5BFY.10.23.C01.1.454.light.4.raw
catagtagtgcacgaccggtgctcgatttagtacacgtgattagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgaggacgaggctgactattactgctcagcatgggacatcagcctcagtggttgggtgttcggcggagggaccaagctgaccgtcctaggtcacg

SEQ ID NO: 548448 - DNA, 484 bp, Homo sapiens; identical to SEQ ID NO: 536162
  misc_feature: HIJSMM301BJ8OS.13.59.F04.1.454.light.4.raw

SEQ ID NO: 548449 - DNA, 485 bp, Homo sapiens
  misc_feature: HIJSMM301EE678.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgaggtggaggatcagacgaaa

SEQ ID NO: 548450 - DNA, 527 bp, Homo sapiens
  misc_feature: HIJSMM301ERJFH.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcaccccccgtgttcggcggggggaccgaagctgaccgtcctaggtcgagcccaacggcgtcgccccctccggtcgacctctgttcccgccccctcctcagacgtactca

SEQ ID NO: 548451 - DNA, 491 bp, Homo sapiens; identical to SEQ ID NO: 536000
  misc_feature: HIJSMM301DVV2W.48.1.A01.1.454.light.4.raw

SEQ ID NO: 548452 - DNA, 489 bp, Homo sapiens
  misc_feature: HIJSMM301A6JQI.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaccta

SEQ ID NO: 548453 - DNA, 474 bp, Homo sapiens
  misc_feature: HIJSMM301ALJCG.3.1.A01.1.454.light.4.raw
agacgcactccacgaccggtgctcgatttagacgtctcatcaggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactagtggctgcaccat

SEQ ID NO: 548454 - DNA, 485 bp, Homo sapiens
  misc_feature: HIJSMM301C5QCJ.51.60.F05.1.454.light.4.raw
cgatcgtatacacgaccggtgctcgatttagtacgtcatcagggaaaggggtgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtctcggtcagcccaaggctcgccccccg

SEQ ID NO: 548455 - DNA, 504 bp, Homo sapiens; identical to SEQ ID NO: 540538
  misc_feature: HIJSMM301AZ4YA.7.71.G05.1.454.light.4.raw

SEQ ID NO: 548456 - DNA, 502 bp, Homo sapiens
  misc_feature: HIJSMM301CMYA5.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccagggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactagtggctgcaccatctgtcttcatt

SEQ ID NO: 548457 - DNA, 498 bp, Homo sapiens
  misc_feature: HIJSMM301CYZPW.48.59.F04.1.454.light.4.raw
agtatacatacacgaccggtgctcgatttagtacacacacttagggattggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 548458 - DNA, 497 bp, Homo sapiens
  misc_feature: HIJSMM301E1KTR.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggt

SEQ ID NO: 548459 - DNA, 503 bp, Homo sapiens
  misc_feature: HIJSMM301EVSNG.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtcccctgaccgattctctggctccaagtctggcacctcagcctccctgaccatcagtgggctccggtccgaggatgaggctgactattactgtgcatcacgggacncaacatgggatggacaatctgagcggttggtgttcggcggagggaccaaactgaccgtcctaggtcagcccaa

SEQ ID NO: 548460 - DNA, 496 bp, Homo sapiens; identical to SEQ ID NO: 536248
  misc_feature: HIJSMM301EOI1G.22.27.C05.1.454.light.4.raw

SEQ ID NO: 548461 - DNA, 490 bp, Homo sapiens
  misc_feature: HIJSMM301DL7MB.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcgagggaccaaggtggagatcaaacgaactgtggctgcaccatctgtcttcatcttcccgcca

SEQ ID NO: 548462 - DNA, 447 bp, Homo sapiens; identical to SEQ ID NO: 535020
  misc_feature: HIJSMM301ESCWQ.18.9.A09.1.454.light.4.raw

SEQ ID NO: 548463 - DNA, 444 bp, Homo sapiens; identical to SEQ ID NO: 535192
  misc_feature: HIJSMM301EAJ6J.5.9.A09.1.454.light.4.raw

SEQ ID NO: 548464 - DNA, 505 bp, Homo sapiens; identical to SEQ ID NO: 535503
  misc_feature: HIJSMM301DLK5J.8.28.C06.1.454.light.4.raw

SEQ ID NO: 548465 - DNA, 503 bp, Homo sapiens; identical to SEQ ID NO: 538884
  misc_feature: HIJSMM301BCOHF.27.78.H01.1.454.light.4.raw

SEQ ID NO: 548466 - DNA, 488 bp, Homo sapiens
  misc_feature: HIJSMM301DTYUI.49.37.D04.1.454.light.4.raw
agtcgagagacacgaccggtgctcgatttagtagcatactgttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 548467 - DNA, 485 bp, Homo sapiens
  misc_feature: HIJSMM301CHL9Y.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttaattctcaccatcagcagcctgcagcctgaagattttgcaacttattactgtctacaagatcacaattatcctgggacgttcggccaagggaccaaggtggaaatcaaacgaaactgtggctgcaccatctgtcttcatt

SEQ ID NO: 548468 - DNA, 484 bp, Homo sapiens
  misc_feature: HIJSMM301CB495.52.37.D04.1.454.light.4.raw
cgcagtacgacacgaccggtgctcgatttagtagcatactgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 548469 - DNA, 483 bp, Homo sapiens
  misc_feature: HIJSMM301DBF1U.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgagattttgcagtttattactgtcagcagtatcatgactggccgctcaccttcggccaagggacacgactggagattaaacgaactgtggctgcaccat

SEQ ID NO: 548470 - DNA, 504 bp, Homo sapiens
  misc_feature: HIJSMM301AJI8A.18.37.D04.1.454.light.4.raw
  modified_base (502)..(502): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattacttgcatgcaaactacacacggccgctcactttcggcggagggaccaaggtggagatcaaacgaactgtggctgcaccanct

SEQ ID NO: 548471 - DNA, 502 bp, Homo sapiens
  misc_feature: HIJSMM301CS56H.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtctacgtcagcccaaggctgccccctcggtcactctgttccccg

SEQ ID NO: 548472 - DNA, 500 bp, Homo sapiens
  misc_feature: HIJSMM301BLWTV.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccatgtcactctcgttccccacctcctcgtactctctcg

SEQ ID NO: 548473 - DNA, 500 bp, Homo sapiens
  misc_feature: HIJSMM301EXIPO.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtcttaggtcagcccaaggctgccccctcggtca

SEQ ID NO: 548474 - DNA, 506 bp, Homo sapiens
  misc_feature: HIJSMM301BCSHK.11.67.G01.1.454.light.4.raw
cgagagataccacgaccggtgctcgatttagagtatacatattgggtttggggggtgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggagtgacggtctgagtgctgtggtcttcggcggagggaccgaagctgaccgtcctgggtcagcccaaggctgccccctccggtcact

SEQ ID NO: 548475 - DNA, 494 bp, Homo sapiens
  misc_feature: HIJSMM301BG8RR.27.78.H01.1.454.light.4.raw
agcgtcgtctcacgaccggtgctcgatttagtgtgagtagtttgggtttggggatgagcaaaactgacaagtcaaggcaggaagatgttgtcatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 548476 - DNA, 494 bp, Homo sapiens; identical to SEQ ID NO: 542031
  misc_feature: HIJSMM301BVIA7.12.23.C01.1.454.light.4.raw

SEQ ID NO: 548477 - DNA, 486 bp, Homo sapiens; identical to SEQ ID NO: 535043
  misc_feature: HIJSMM301EORPU.46.35.D02.1.454.light.4.raw

SEQ ID NO: 548478 - DNA, 503 bp, Homo sapiens; identical to SEQ ID NO: 545496
  misc_feature: HIJSMM301BSAB0.8.24.C02.1.454.light.4.raw

SEQ ID NO: 548479 - DNA, 460 bp, Homo sapiens; identical to SEQ ID NO: 539553
  misc_feature: HIJSMM301EBEZ4.11.86.H09.1.454.light.4.raw

SEQ ID NO: 548480 - DNA, 444 bp, Homo sapiens; identical to SEQ ID NO: 534993
  misc_feature: HIJSMM301CNLM6.5.9.A09.1.454.light.4.raw

SEQ ID NO: 548481 - DNA, 494 bp, Homo sapiens; identical to SEQ ID NO: 537607
  misc_feature: HIJSMM301ECBEW.52.10.A10.1.454.light.4.raw

SEQ ID NO: 548482 - DNA, 501 bp, Homo sapiens
  misc_feature: HIJSMM301BK33R.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccg

SEQ ID NO: 548483 - DNA, 464 bp, Homo sapiens; identical to SEQ ID NO: 536640
  misc_feature: HIJSMM301C600R.26.78.H01.1.454.light.4.raw

SEQ ID NO: 548484 - DNA, 494 bp, Homo sapiens; identical to SEQ ID NO: 535828
  misc_feature: HIJSMM301C7GHV.3.36.D03.1.454.light.4.raw

SEQ ID NO: 548485 - DNA, 501 bp, Homo sapiens
  misc_feature: HIJSMM301BDJMI.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatgacccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtccaggtcagcccaa

SEQ ID NO: 548486 - DNA, 484 bp, Homo sapiens; identical to SEQ ID NO: 535400
  misc_feature: HIJSMM301ED8IK.46.26.C04.1.454.light.4.raw

SEQ ID NO: 548487 - DNA, 492 bp, Homo sapiens
  misc_feature: HIJSMM301BRLE5.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttatactgtcagcaatattctactactcctcggactttcggcggagggaccgaacggtggagagtcaaacgaaactc

SEQ ID NO: 548488 - DNA, 447 bp, Homo sapiens; identical to SEQ ID NO: 535882
  misc_feature: HIJSMM301CRRF3.18.9.A09.1.454.light.4.raw
  modified_base (429)..(429): a, c, t, g, unknown or other

SEQ ID NO: 548489 - DNA, 454 bp, Homo sapiens; identical to SEQ ID NO: 535005
  misc_feature: HIJSMM301A80CU.19.86.H09.1.454.light.4.raw

SEQ ID NO: 548490 - DNA, 485 bp, Homo sapiens; identical to SEQ ID NO: 535653
  misc_feature: HIJSMM301EMLI1.47.62.F07.1.454.light.4.raw

SEQ ID NO: 548491 - DNA, 497 bp, Homo sapiens
  misc_feature: HIJSMM301A5LG5.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcccgaagattttgcagtttattactgtcagcagcgtagcaactccctcacgttcggcggagggaccaaggtggagatcaaacgaactgtggctgcaccatctgtcttcatcttcccgccat

SEQ ID NO: 548492 - DNA, 497 bp, Homo sapiens
  misc_feature: HIJSMM301C7MYO.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccgggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggggcgcgcgttttcggcgggggacggaacggtaggacgatacaaacgaactagtggcgtcgcaccactact

SEQ ID NO: 548493 - DNA, 514 bp, Homo sapiens
  misc_feature: HIJSMM301CPKFP.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaagggaccgaacggtaggaagtacgaaacgaactacgtggcgtgcaccatctgtcttctatcttccgtccact

SEQ ID NO: 548494 - DNA, 444 bp, Homo sapiens; identical to SEQ ID NO: 534993
  misc_feature: HIJSMM301BB16Y.5.9.A09.1.454.light.4.raw

SEQ ID NO: 548495 - DNA, 512 bp, Homo sapiens
  misc_feature: HIJSMM301EDHUM.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 548496 - DNA, 489 bp, Homo sapiens; identical to SEQ ID NO: 548146
  misc_feature: HIJSMM301AU7MJ.51.6.A06.1.454.light.4.raw

SEQ ID NO: 548497 - DNA, 487 bp, Homo sapiens; identical to SEQ ID NO: 536536
  misc_feature: HIJSMM301CGRM9.26.45.E01.1.454.light.4.raw

SEQ ID NO: 548498 - DNA, 447 bp, Homo sapiens; identical to SEQ ID NO: 535020
  misc_feature: HIJSMM301EW3K5.18.9.A09.1.454.light.4.raw

SEQ ID NO: 548499 - DNA, 483 bp, Homo sapiens; identical to SEQ ID NO: 542318
  misc_feature: HIJSMM301C3TB6.13.59.F04.1.454.light.4.raw

SEQ ID NO: 548500 - DNA, 499 bp, Homo sapiens; identical to SEQ ID NO: 545202
  misc_feature: HIJSMM301B1RRL.12.26.C04.1.454.light.4.raw

SEQ ID NO: 548501 - DNA, 494 bp, Homo sapiens
  misc_feature: HIJSMM301B9THM.52.54.E10.1.454.light.4.raw
cgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 548502 - DNA, 489 bp, Homo sapiens; identical to SEQ ID NO: 535139
  misc_feature: HIJSMM301D4GBX.14.55.E11.1.454.light.4.raw

SEQ ID NO: 548503 - DNA, 485 bp, Homo sapiens
  misc_feature: HIJSMM301B3OS1.48.53.E09.1.454.light.4.raw
agtatacatacacgaccggtgctcgatttagagagagtgtgttgggtttgggggctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcacc

SEQ ID NO: 548504 - DNA, 474 bp, Homo sapiens
  misc_feature: HIJSMM301CWO8B.40.23.C01.1.454.light.4.raw
tctagcgactcacgaccggtgctcgatttagtacacgtgattagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacgcagccactctgaccatcagcgggacccaggctatggatgaggctgactattactgtcaggcgtgggacgatcagcagtgaggtggttttcggcggagggaccaagctgaccgtccaagtcagccc

SEQ ID NO: 548505 - DNA, 514 bp, Homo sapiens
  misc_feature: HIJSMM301C1G7L.21.87.H10.1.454.light.4.raw
  modified_base (493)..(494): a, c, t, g, unknown or other
tcgtcgctcgcacgaccggtgctcgatttagcagtactgcgttggggtttggggggggtcgacaagaggcagcgctctcgggacggtctccaccatggcctgggcgtctgctgctcctcactctcctcactcagggcacagggtcctgggcccagtctgccctgactcagcctgcctccgtgtctgggtctcccgggcagtcggtcaccatctcttgcgctggatccagcgatgatatttggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttggtttttggcggcgggacccagattgactgtcctcagtcnncccaaggctgccccctcggt

SEQ ID NO: 548506 - DNA, 479 bp, Homo sapiens; identical to SEQ ID NO: 540873
  misc_feature: HIJSMM301BA9P5.40.59.F04.1.454.light.4.raw

SEQ ID NO: 548507 - DNA, 499 bp, Homo sapiens
  misc_feature: HIJSMM301DZKAZ.48.28.C06.1.454.light.4.raw
agtatacatacacgaccggtgctcgatttagagctcacgtattgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 548508 - DNA, 487 bp, Homo sapiens; identical to SEQ ID NO: 537573
  misc_feature: HIJSMM301BE1XD.3.10.A10.1.454.light.4.raw

SEQ ID NO: 548509 - DNA, 494 bp, Homo sapiens; identical to SEQ ID NO: 534992
  misc_feature: HIJSMM301CGTJD.9.1.A01.1.454.light.4.raw

SEQ ID NO: 548510 - DNA, 483 bp, Homo sapiens
  misc_feature: HIJSMM301CRKLK.4.7.A07.1.454.light.4.raw
agcactgtagcacgaccggtgctcgatttagcacgtgtcgcagggggaaaggccctgaggaaaacaaaccccagctgggaagcctgagaacacttagccttcatgagtgtccccaccatggcctggatgatgcttctcctcggactccttgcttatggatcaggagtgaattctcagactgtggtgacccaggagccatcgttctcagtgtcccctggagggacagtcacactcacttgtgacttgagctctggctcagtctctactagttactgccccagctggtaccagcagaccccaggcctgactccacgcacgctcatctacagcacaagcgctcgctcttctggggtccctgatcgcttctctggctccatccttgggaacaaagctgcccctcaccatcacgggggcccaggcagatggtcagcccaaggctgcccctccggtcactctgttcccaccctccctcctaccagtgct

SEQ ID NO: 548511 - DNA, 515 bp, Homo sapiens
  misc_feature: HIJSMM301CJP06.51.43.D10.1.454.light.4.raw
cgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccaccctcctctcgt

SEQ ID NO: 548512 - DNA, 488 bp, Homo sapiens; identical to SEQ ID NO: 536710
  misc_feature: HIJSMM301D9XB2.21.55.E11.1.454.light.4.raw

SEQ ID NO: 548513 - DNA, 493 bp, Homo sapiens
  misc_feature: HIJSMM301A6QBH.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgtgg

SEQ ID NO: 548514 - DNA, 485 bp, Homo sapiens; identical to SEQ ID NO: 536075
  misc_feature: HIJSMM301AXDLI.17.21.B10.1.454.light.4.raw

SEQ ID NO: 548515 - DNA, 474 bp, Homo sapiens; identical to SEQ ID NO: 548202
  misc_feature: HIJSMM301CO024.3.1.A01.1.454.light.4.raw

SEQ ID NO: 548516 - DNA, 482 bp, Homo sapiens
  misc_feature: HIJSMM301ANE6U.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctcgttcccaccctcctccgtcgtctgat

SEQ ID NO: 548517 - DNA, 486 bp, Homo sapiens; identical to SEQ ID NO: 536653
  misc_feature: HIJSMM301BW77T.19.71.G05.1.454.light.4.raw

SEQ ID NO: 548518 - DNA, 496 bp, Homo sapiens
  misc_feature: HIJSMM301CLK0N.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctctcggacctgggaccaggtcaccgtct

SEQ ID NO: 548519 - DNA, 489 bp, Homo sapiens; identical to SEQ ID NO: 535139
  misc_feature: HIJSMM301AZBHW.14.55.E11.1.454.light.4.raw

SEQ ID NO: 548520 - DNA, 383 bp, Homo sapiens
  misc_feature: HIJSMM301D7PZ2.41.78.H01.1.454.light.4.raw
tctatactatcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 548521 - DNA, 508 bp, Homo sapiens
  misc_feature: HIJSMM301AW2RP.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgtctgat

SEQ ID NO: 548522 - DNA, 489 bp, Homo sapiens; identical to SEQ ID NO: 535139
  misc_feature: HIJSMM301AVMZE.14.55.E11.1.454.light.4.raw

SEQ ID NO: 548523 - DNA, 501 bp, Homo sapiens
  misc_feature: HIJSMM301AWLGJ.48.36.D03.1.454.light.4.raw
agtatacatacacgaccggtgctcgatttagctgcgtcacgatctctcttgggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtcccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttccttttttgtcttcggaactggaccgaggtcaccgtcctaggtcagcccaaggccaacccactgtc

SEQ ID NO: 548524 - DNA, 485 bp, Homo sapiens
  misc_feature: HIJSMM301ELFS3.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctggaccaaagtggattcaaacgaactgtggctgcacc

SEQ ID NO: 548525 - DNA, 460 bp, Homo sapiens; identical to SEQ ID NO: 536053
  misc_feature: HIJSMM301EWDGA.22.28.C06.1.454.light.4.raw

SEQ ID NO: 548526 - DNA, 496 bp, Homo sapiens; identical to SEQ ID NO: 536063
  misc_feature: HIJSMM301BVZUS.5.49.E05.1.454.light.4.raw

SEQ ID NO: 548527 - DNA, 444 bp, Homo sapiens; identical to SEQ ID NO: 536096
  misc_feature: HIJSMM301D2WYT.7.18.B07.1.454.light.4.raw

SEQ ID NO: 548528 - DNA, 440 bp, Homo sapiens
  misc_feature: HIJSMM301EGN9M.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcagctcatatacaagcagcagcactcaagtcttcggaactgggaccaaggtcaccgtcctaggtcagcccaaggccaacccactgtcactctgttcccaccctcctccatactcgta

SEQ ID NO: 548529 - DNA, 496 bp, Homo sapiens; identical to SEQ ID NO: 536248
  misc_feature: HIJSMM301C9NS0.22.27.C05.1.454.light.4.raw

SEQ ID NO: 548530 - DNA, 354 bp, Homo sapiens; identical to SEQ ID NO: 535026
  misc_feature: HIJSMM301EL7XT.19.22.B11.1.454.light.4.raw

SEQ ID NO: 548531 - DNA, 435 bp, Homo sapiens
  misc_feature: HIJSMM301B8CP5.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgttacacttttggccaggggaccaagctggagatcaaacgaactgtggctgcaccatctgtcttcatcttcccgccatctgacatactcgta

SEQ ID NO: 548532 - DNA, 507 bp, Homo sapiens
  misc_feature: HIJSMM301BZGYF.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagttaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccgaacggtggaaatacaaacgaaactgtggctgcaccatctgtcttcatt

SEQ ID NO: 548533 - DNA, 484 bp, Homo sapiens
  misc_feature: HIJSMM301EPWBG.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagacgttacggtaccctgctcactttcggcggagggaccaaggtggagatcaaacgaactgtggctgcacta

SEQ ID NO: 548534 - DNA, 513 bp, Homo sapiens
  misc_feature: HIJSMM301C8KL5.18.26.C04.1.454.light.4.raw
tacgagtatgcacgaccggtgctcgatttagtctagcgacttttggggtttgggggggtcgagacccacgtcgggacgacagcatggacgatgagggtccccggcctcagctcctggggcgtcctgctgctctggttcccacggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctggggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccca

SEQ ID NO: 548535 - DNA, 491 bp, Homo sapiens
  misc_feature: HIJSMM301CRAX1.51.71.G05.1.454.light.4.raw
cgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccca

SEQ ID NO: 548536 - DNA, 505 bp, Homo sapiens
  misc_feature: HIJSMM301ATGS0.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattatactgcagcttatatacaggcaacaatacttttgtcttcggaactgggaccaaggtcaccgtcctaggtcagcccaaggccaacccactgtcact

SEQ ID NO: 548537 - DNA, 491 bp, Homo sapiens; identical to SEQ ID NO: 536211
  misc_feature: HIJSMM301CJ31T.16.53.E09.1.454.light.4.raw

SEQ ID NO: 548538 - DNA, 500 bp, Homo sapiens
  misc_feature: HIJSMM301A2TLL.48.53.E09.1.454.light.4.raw
agtatacatacacgaccggtgctcgatttagagagagtgtgttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacgttgggtgttcggcagagggaccaagctgaccgtcctaggtcagcccaaggctgcccccc

SEQ ID NO: 548539 - DNA, 493 bp, Homo sapiens
  misc_feature: HIJSMM301EYXXC.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggtagggaccgagggtggagatcagacgaactgtggctgcaccatctgtt

SEQ ID NO: 548540 - DNA, 512 bp, Homo sapiens
  misc_feature: HIJSMM301DUJBP.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcctcgctacg

SEQ ID NO: 548541 - DNA, 502 bp, Homo sapiens; identical to SEQ ID NO: 540196
  misc_feature: HIJSMM301CN4H2.40.45.E01.1.454.light.4.raw

SEQ ID NO: 548542 - DNA, 485 bp, Homo sapiens; identical to SEQ ID NO: 535606
  misc_feature: HIJSMM301B065Q.47.46.E02.1.454.light.4.raw

SEQ ID NO: 548543 - DNA, 497 bp, Homo sapiens; identical to SEQ ID NO: 535286
  misc_feature: HIJSMM301AQQQM.18.59.F04.1.454.light.4.raw

SEQ ID NO: 548544 - DNA, 498 bp, Homo sapiens
  misc_feature: HIJSMM301A2ZHP.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaatcaaacgaactgtggctgcacca

SEQ ID NO: 548545 - DNA, 511 bp, Homo sapiens
  misc_feature: HIJSMM301AKF13.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaaggtaggaaagtacaaacgaacctagtggctgcaccatctgtcttctatcttccccg

SEQ ID NO: 548546 - DNA, 465 bp, Homo sapiens; identical to SEQ ID NO: 540680
  misc_feature: HIJSMM301CV7G8.17.28.C06.1.454.light.4.raw

SEQ ID NO: 548547 - DNA, 512 bp, Homo sapiens; identical to SEQ ID NO: 541402
  misc_feature: HIJSMM301DR7GU.43.19.B08.1.454.light.4.raw

SEQ ID NO: 548548 - DNA, 494 bp, Homo sapiens; identical to SEQ ID NO: 543247
  misc_feature: HIJSMM301CNP8X.22.57.F02.1.454.light.4.raw

SEQ ID NO: 548549 - DNA, 498 bp, Homo sapiens
  misc_feature: HIJSMM301EUNLL.51.34.D01.1.454.light.4.raw
cgatcgtatacacgaccggtgctcgatttagatcgtctgtgttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactt

SEQ ID NO: 548550 - DNA, 518 bp, Homo sapiens
  misc_feature: HIJSMM301CQ09Z.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcggccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccgccctcctcg

SEQ ID NO: 548551 - DNA, 520 bp, Homo sapiens; identical to SEQ ID NO: 543171
  misc_feature: HIJSMM301DQNN9.48.24.C02.1.454.light.4.raw

SEQ ID NO: 548552 - DNA, 498 bp, Homo sapiens
  misc_feature: HIJSMM301ER35J.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactcgtggctgcaccatctgtcttcatt

SEQ ID NO: 548553 - DNA, 513 bp, Homo sapiens
  misc_feature: HIJSMM301D9OAS.22.30.C08.1.454.light.4.raw
  modified_base (505)..(505): a, c, t, g, unknown or other
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccnccctcctc

SEQ ID NO: 548554 - DNA, 517 bp, Homo sapiens
  misc_feature: HIJSMM301EYOGQ.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggaggcctcagttggaagcagccgatccagcctgcggagcctgtgggcaggtcagcccaaggccaacccactgtcactctcg

SEQ ID NO: 548555 - DNA, 507 bp, Homo sapiens
  misc_feature: HIJSMM301DM7Y5.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccaaggtggaaagtcaaacgaactagtggctgcaccatctgtcttctatcttccccg

SEQ ID NO: 548556 - DNA, 507 bp, Homo sapiens
  misc_feature: HIJSMM301ASOQJ.8.28.C06.1.454.light.4.raw
ctcgcgtgtccacgaccggtgctcgatttagagctcacgtattgggtttggggagagctctggggaggaactgctcagttaggacccagacggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcta

SEQ ID NO: 548557 - DNA, 479 bp, Homo sapiens; identical to SEQ ID NO: 535531
  misc_feature: HIJSMM301CJB8U.41.17.B06.1.454.light.4.raw

SEQ ID NO: 548558 - DNA, 494 bp, Homo sapiens; identical to SEQ ID NO: 534992
  misc_feature: HIJSMM301D8H2E.9.1.A01.1.454.light.4.raw

SEQ ID NO: 548559 - DNA, 497 bp, Homo sapiens
  misc_feature: HIJSMM301DF7OE.48.31.C09.1.454.light.4.raw
agtatacatacacgaccggtgctcgatttagacgtctcatcaaggaaggaaggggagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttccg

SEQ ID NO: 548560 - DNA, 444 bp, Homo sapiens; identical to SEQ ID NO: 534993
  misc_feature: HIJSMM301ETEX3.5.9.A09.1.454.light.4.raw

SEQ ID NO: 548561 - DNA, 498 bp, Homo sapiens; identical to SEQ ID NO: 536170
  misc_feature: HIJSMM301CKVP6.41.82.H05.1.454.light.4.raw

SEQ ID NO: 548562 - DNA, 490 bp, Homo sapiens; identical to SEQ ID NO: 535936
  misc_feature: HIJSMM301BQ3DZ.16.68.G02.1.454.light.4.raw

SEQ ID NO: 548563 - DNA, 498 bp, Homo sapiens
  misc_feature: HIJSMM301EMC1R.2.35.D02.1.454.light.4.raw
  modified_base (472)..(472): a, c, t, g, unknown or other
acgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtccngggtcagcccaaggctgccccctggt

SEQ ID NO: 548564 - DNA, 495 bp, Homo sapiens
  misc_feature: HIJSMM301B5FJ8.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggcccaagggacacgactggagattaaaggaactgtggctgcaccatctgtcttcatcttccccg

SEQ ID NO: 548565 - DNA, 509 bp, Homo sapiens
  misc_feature: HIJSMM301D28BY.40.48.E04.1.454.light.4.raw
tctagcgactcacgaccggtgctcgatttagagagcgtcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcta

SEQ ID NO: 548566 - DNA, 485 bp, Homo sapiens
  misc_feature: HIJSMM301CMR09.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatcctgactagtctacg

SEQ ID NO: 548567 - DNA, 521 bp, Homo sapiens
  misc_feature: HIJSMM301A98JY.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcattatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggtcggaggcaccgaagtgaccgtccctcggtcagcccaacggcgtcgccccctccggtcactcttcg

SEQ ID NO: 548568 - DNA, 493 bp, Homo sapiens
  misc_feature: HIJSMM301C8FC6.11.76.G10.1.454.light.4.raw
  modified_base (473)..(473): a, c, t, g, unknown or other
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttactactctcaccatcaataagcctgcaggctgaagatgtggcagcttattattgtcagcaatattatattctcttccgtactcacctttgttcgacgggacggacggcgtgnggaagtcagacgaacgtagt

SEQ ID NO: 548569 - DNA, 502 bp, Homo sapiens
  misc_feature: HIJSMM301BO3BD.48.37.D04.1.454.light.4.raw
agtatacatacacgaccggtgctcgatttagtagcatactgttgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttcccg

SEQ ID NO: 548570 - DNA, 503 bp, Homo sapiens
  misc_feature: HIJSMM301C4UA6.52.53.E09.1.454.light.4.raw
cgcagtacgacacgaccggtgctcgatttagagagagtgtgttgggtttgggggaggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcttccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaaacgaactgtggctgcaccatctgtcttcta

SEQ ID NO: 548571 - DNA, 488 bp, Homo sapiens
  misc_feature: HIJSMM301DOI9T.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccccggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 548572 - DNA, 526 bp, Homo sapiens
  misc_feature: HIJSMM301AUQ16.11.58.F03.1.454.light.4.raw
cgagagataccacgaccggtgctcgatttagtctgatcgagaagggaaaggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttggtaccgacagaccccaggccagcctccacgcacgctcatttataacacaaagactcgctcttctggggtccctaatcgcttctctggctccatccttgggaacaaagctgccctcaccatcacgggggcccaggcgacgatgaatctatttattattgtgttacttttgtgggtcgtggcatttctgctgtgttcggcggaggcacccaggtgaccgtcctcggtcagcccaaggctgcccccatcggtcactctgttcccgccct

SEQ ID NO: 548573 - DNA, 517 bp, Homo sapiens; identical to SEQ ID NO: 536262
  misc_feature: HIJSMM301EMIVQ.14.70.G04.1.454.light.4.raw

SEQ ID NO: 548574 - DNA, 497 bp, Homo sapiens
  misc_feature: HIJSMM301C2A8T.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacggggaccgaacggtaggaaatacaaacgaacctagtggcgtgcaccaa

SEQ ID NO: 548575 - DNA, 460 bp, Homo sapiens; identical to SEQ ID NO: 536053
  misc_feature: HIJSMM301EICUV.22.28.C06.1.454.light.4.raw

SEQ ID NO: 548576 - DNA, 505 bp, Homo sapiens
  misc_feature: HIJSMM301CPOYV.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgccccccg

SEQ ID NO: 548577 - DNA, 470 bp, Homo sapiens
  misc_feature: HIJSMM301C3CNQ.48.49.E05.1.454.light.4.raw
agtatacatacacgaccggtgctcgatttagagcgactagcaacacacaaaggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaa

SEQ ID NO: 548578 - DNA, 497 bp, Homo sapiens
  misc_feature: HIJSMM301AKDT1.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccgaagggaccaaggtggaaatcaaacgaactgtggctgcacc

SEQ ID NO: 548579 - DNA, 501 bp, Homo sapiens
  misc_feature: HIJSMM301CZK6R.51.26.C04.1.454.light.4.raw
cgatcgtatacacgaccggtgctcgatttagtctagcgactttgggtttgggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccaggtctgaccgtcctaggtcagcccaaggctgccccctcggtcactctgttccca

SEQ ID NO: 548580 - DNA, 496 bp, Homo sapiens; identical to SEQ ID NO: 535541
  misc_feature: HIJSMM301APUDI.3.33.C11.1.454.light.4.raw

SEQ ID NO: 548581 - DNA, 506 bp, Homo sapiens
  misc_feature: HIJSMM301BBSCI.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttccca

SEQ ID NO: 548582 - DNA, 488 bp, Homo sapiens
  misc_feature: HIJSMM301BU70J.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagtacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatct

SEQ ID NO: 548583 - DNA, 477 bp, Homo sapiens; identical to SEQ ID NO: 535506
  misc_feature: HIJSMM301BIHCK.7.67.G01.1.454.light.4.raw

SEQ ID NO: 548584 - DNA, 507 bp, Homo sapiens; identical to SEQ ID NO: 538702
  misc_feature: HIJSMM301A5EOB.11.57.F02.1.454.light.4.raw

SEQ ID NO: 548585 - DNA, 511 bp, Homo sapiens
  misc_feature: HIJSMM301C0PWE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtaggaagtacaagacgaactagtggcgtgcgaccatctgtcttctatcttcccgt

SEQ ID NO: 548586 - DNA, 483 bp, Homo sapiens
  misc_feature: HIJSMM301CQJ9P.41.12.B01.1.454.light.4.raw
tctatactatcacgaccggtgctcgatttagtagtgtagattccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttcccctcactttcggcggagggaccagggtggagatcaaacgaactgtggctgcaccat

SEQ ID NO: 548587 - DNA, 489 bp, Homo sapiens
  misc_feature: HIJSMM301BW34K.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaacgaactgtggctgcaccatctgtcttcatt

SEQ ID NO: 548588 - DNA, 486 bp, Homo sapiens; identical to SEQ ID NO: 535917
  misc_feature: HIJSMM301CIJ01.3.10.A10.1.454.light.4.raw

SEQ ID NO: 548589 - DNA, 444 bp, Homo sapiens; identical to SEQ ID NO: 535192
  misc_feature: HIJSMM301DC9PM.5.9.A09.1.454.light.4.raw

SEQ ID NO: 548590 - DNA, 503 bp, Homo sapiens; identical to SEQ ID NO: 535044
  misc_feature: HIJSMM301BV8RV.19.78.H01.1.454.light.4.raw

SEQ ID NO: 548591 - DNA, 456 bp, Homo sapiens
  misc_feature: HIJSMM301BN6FP.19.86.H09.1.454.light.4.raw
tactctcgtgcacgaccggtgctcgatttagtgctatagacttgggtttgggggccgttcctgggcccagtctgtgctgactcaggcaccctcagcgtctcgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 548592 - DNA, 494 bp, Homo sapiens; identical to SEQ ID NO: 534994
  misc_feature: HIJSMM301DYIB6.27.78.H01.1.454.light.4.raw

SEQ ID NO: 548593 - DNA, 483 bp, Homo sapiens
  misc_feature: HIJSMM301AN2TV.51.52.E08.1.454.light.4.raw
cgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattctgggatattcggcggagggaccaagctgaccgtcttaggtcagcccaaggctcg

SEQ ID NO: 548594 - DNA, 489 bp, Homo sapiens
  misc_feature: HIJSMM301CIPDF.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggcttccagaatccgctggagaaatcgtagtgacgcagtctccagccaccctgtctgtgtctccaggggagagagccaccctctcctgcagggccaatcagagtattggtcacagcttagcctggtaccagcagaaaccttggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaagtacaaacgaaactagtggctgcaccactctgtctt

SEQ ID NO: 548595 - DNA, 496 bp, Homo sapiens; identical to SEQ ID NO: 535109
  misc_feature: HIJSMM301BZTV6.16.78.H01.1.454.light.4.raw

SEQ ID NO: 548596 - DNA, 471 bp, Homo sapiens
  misc_feature: HIJSMM301BZBNE.3.56.F01.1.454.light.4.raw
agacgcactccacgaccggtgctcgatttagcagacgtctgaacacacaaagggggagtcagtcccaaccaggacacagcatggacatgagggtccctgcccagctcctggggctcctgctgctctggctctcaggtgccagatgtgacatccagatgacccagtctccaccctccctgtctgcttctgtaggagatagagtcatcatcacttgccaggcgagtcaagacattagtgacaatttaaattggtatcaccagaaaccaggggaagcccctaagctcctgatctacgatgcatccagtttgcaaacagggtcccatcaaggttcagtggacgtggatctgggacagatttcacttgcaccatcagcggcctgcagcctgaagatgttggaacatattactgtcaacagtatgatcagctcctttcttcggccctgggccaaagtggaaatcaggcgaactgtgg

SEQ ID NO: 548597 - DNA, 498 bp, Homo sapiens
  misc_feature: HIJSMM301DRD20.52.38.D05.1.454.light.4.raw
cgcagtacgacacgaccggtgctcgatttagtatctgatagttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctcgtgggactgagcgctacctcaccatctccagccctccagtctggaggacggagggtgactattactgtcaggacgtgggacacgtggcagttttgggtgttcgggacgggagggaccaagttcgaccgtcctaggtcagcccaaggctccg

SEQ ID NO: 548598 - DNA, 497 bp, Homo sapiens
  misc_feature: HIJSMM301EFRO8.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtccctgaccgattctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 548599 - DNA, 491 bp, Homo sapiens
  misc_feature: HIJSMM301BNH3C.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcatt

SEQ ID NO: 548600 - DNA, 493 bp, Homo sapiens; identical to SEQ ID NO: 547772
  misc_feature: HIJSMM301DK7OK.47.64.F09.1.454.light.4.raw

SEQ ID NO: 548601 - DNA, 507 bp, Homo sapiens; identical to SEQ ID NO: 535355
  misc_feature: HIJSMM301EQ2NL.9.12.B01.1.454.light.4.raw

SEQ ID NO: 548602 - DNA, 447 bp, Homo sapiens; identical to SEQ ID NO: 535020
  misc_feature: HIJSMM301BS2OW.18.9.A09.1.454.light.4.raw

SEQ ID NO: 548603 - DNA, 471 bp, Homo sapiens
  misc_feature: HIJSMM301ES6NR.48.56.F01.1.454.light.4.raw
agtatacatacacgaccggtgctcgatttagcagacgtctgaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaacgaa

SEQ ID NO: 548604 - DNA, 520 bp, Homo sapiens
  misc_feature: HIJSMM301CHVOF.43.27.C05.1.454.light.4.raw
tgtgagtagtcacgaccggtgctcgatttagacgcgatcgaagggtttggggagcttcagctgtggtagagaagacaggattcaggacaatctccagcatggccggcttccctctcctcctcaccctcctcactcactgtgcagggtcctgggcccagtctgtactgactcagccaccctcagcgtctgggacccccgggcagagggtcaccatctcttgttctgggacctactccaacatcggaagtaattatgtttactggtaccagcagctcccaggaacggcccccaaactcctcatctataggaataaatcagcggccctcaggggtccctgaccgattctctggctccaagtctggcacctcagcctccctggccatccgtgggctccggtccgaggatgaggctgattattactgtgcaacatgggatgacaccctgagtgcctatgtggttttcggcggagggaccaagctgaccgtccaaggtcagcccaaaggctgccccctcggtcact

SEQ ID NO: 548605 - DNA, 489 bp, Homo sapiens
  misc_feature: HIJSMM301AWH4D.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaaggaccgaacggtaggaaagtactaaacgaactagtggctgcacc

SEQ ID NO: 548606 - DNA, 502 bp, Homo sapiens
  misc_feature: HIJSMM301BP45F.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtctaggtcagcccaaggctgccccctcggt

SEQ ID NO: 548607 - DNA, 500 bp, Homo sapiens
  misc_feature: HIJSMM301C3MWB.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccacctcctctacgtcgtat

SEQ ID NO: 548608 - DNA, 497 bp, Homo sapiens
  misc_feature: HIJSMM301BFHVY.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcta

SEQ ID NO: 548609 - DNA, 500 bp, Homo sapiens
  misc_feature: HIJSMM301BXWVX.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctggtca

SEQ ID NO: 548610 - DNA, 486 bp, Homo sapiens
  misc_feature: HIJSMM301EFHMM.26.45.E01.1.454.light.4.raw
  modified_base (54)..(54): a, c, t, g, unknown or other
agactatactcacgaccggtgctcgatttagtgagtcagtaagggaaaggggtnatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaagtggagatcaaacgaactgt

SEQ ID NO: 548611 - DNA, 504 bp, Homo sapiens
  misc_feature: HIJSMM301BS07P.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccccg

SEQ ID NO: 548612 - DNA, 494 bp, Homo sapiens
  misc_feature: HIJSMM301DHFWJ.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaagggtggagatcaaacgaactgtggctgcaccatctgtcttcta

SEQ ID NO: 548613 - DNA, 497 bp, Homo sapiens
  misc_feature: HIJSMM301CQPC0.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccaacagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcc

SEQ ID NO: 548614 - DNA, 476 bp, Homo sapiens; identical to SEQ ID NO: 538611
  misc_feature: HIJSMM301APU4Q.7.81.H04.1.454.light.4.raw

SEQ ID NO: 548615 - DNA, 494 bp, Homo sapiens; identical to SEQ ID NO: 534992
  misc_feature: HIJSMM301C9X46.9.1.A01.1.454.light.4.raw

SEQ ID NO: 548616 - DNA, 483 bp, Homo sapiens
  misc_feature: HIJSMM301A7QP3.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgaggtggagatcagacgaa

SEQ ID NO: 548617 - DNA, 488 bp, Homo sapiens; identical to SEQ ID NO: 542699
  misc_feature: HIJSMM301BPB24.12.51.E07.1.454.light.4.raw

SEQ ID NO: 548618 - DNA, 504 bp, Homo sapiens
  misc_feature: HIJSMM301B4XEV.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggctccaggctgaagacgaggctgattattactgcagctcatatacaggcagcagcactcaggttttcggtcggagggaccgaagactgaccgtcctacggtcagcccaaggctgccccctcggtcc

SEQ ID NO: 548619 - DNA, 500 bp, Homo sapiens; identical to SEQ ID NO: 546613
  misc_feature: HIJSMM301CDDZU.11.21.B10.1.454.light.4.raw

SEQ ID NO: 548620 - DNA, 360 bp, Homo sapiens
  misc_feature: HIJSMM301CMOR7.3.57.F02.1.454.light.4.raw
agacgcactccacgaccggtgctcgatttagctcgatatagttgggtttgggggtgtggtggtctccactcccgccttgacggggcgtgctatctgccttccaggccctatcctggtcatcaattatgacagcgaccggccctcagggatccctgagcgattctctggctctaactctgggaacacggccaccctgaccatcaccagggtcgaggccgagtatgaggccgactattactgtcaggtgtgggatagccgttctgatcattgggtcttcggcggcgggaccaagctgaccgtcctatgtcaacccaaggctggccctcggtcactctgttcccaccctcctcgagtgcgtct

SEQ ID NO: 548621 - DNA, 447 bp, Homo sapiens; identical to SEQ ID NO: 535020
  misc_feature: HIJSMM301CARCL.18.9.A09.1.454.light.4.raw

SEQ ID NO: 548622 - DNA, 498 bp, Homo sapiens
  misc_feature: HIJSMM301CC280.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccaccctcctcgtatctctcg

SEQ ID NO: 548623 - DNA, 384 bp, Homo sapiens; identical to SEQ ID NO: 540798
  misc_feature: HIJSMM301BJ2FW.17.25.C03.1.454.light.4.raw

SEQ ID NO: 548624 - DNA, 487 bp, Homo sapiens
  misc_feature: HIJSMM301BM3OJ.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcagggcgttgcaaatgctttggcctggtttcagcagacaccagggaacggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggtactttcggccgaacgggaaccgaacggtaggaagtacaaacgaaactgtggc

SEQ ID NO: 548625 - DNA, 494 bp, Homo sapiens
  misc_feature: HIJSMM301AHTBY.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaaggtggagatcaagcgaactgtggctgcaccatctgtcttctatcttcccgt

SEQ ID NO: 548626 - DNA, 493 bp, Homo sapiens
  misc_feature: HIJSMM301ADJV9.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccgaaggtggagatcaaacgaactgtgg

SEQ ID NO: 548627 - DNA, 492 bp, Homo sapiens; identical to SEQ ID NO: 536671
  misc_feature: HIJSMM301DNVX3.9.34.D01.1.454.light.4.raw

SEQ ID NO: 548628 - DNA, 487 bp, Homo sapiens
  misc_feature: HIJSMM301CBA1P.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatacaaacgaactgtggctgcaccatct

SEQ ID NO: 548629 - DNA, 508 bp, Homo sapiens
  misc_feature: HIJSMM301DN2LR.49.23.C01.1.454.light.4.raw
agtcgagagacacgaccggtgctcgatttagtacacgtgattagagattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttccca

SEQ ID NO: 548630 - DNA, 478 bp, Homo sapiens; identical to SEQ ID NO: 541928
  misc_feature: HIJSMM301CIQGJ.7.76.G10.1.454.light.4.raw

SEQ ID NO: 548631 - DNA, 507 bp, Homo sapiens; identical to SEQ ID NO: 543021
  misc_feature: HIJSMM301EUNX1.40.16.B05.1.454.light.4.raw

SEQ ID NO: 548632 - DNA, 499 bp, Homo sapiens
  misc_feature: HIJSMM301E2C6C.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagtattttggaattttattactgtcaacagcgtagcaactggcctcccactttcggcggagggaccaaggtggagatcaagcgaactgtggctgcaccatctgtcttcatcttcccgc

SEQ ID NO: 548633 - DNA, 500 bp, Homo sapiens
  misc_feature: HIJSMM301CDAP0.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtctaggtcagcccaaggctgccccctcggtca

SEQ ID NO: 548634 - DNA, 508 bp, Homo sapiens
  misc_feature: HIJSMM301D6C3F.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgcccccg

SEQ ID NO: 548635 - DNA, 507 bp, Homo sapiens
  misc_feature: HIJSMM301DM7PT.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccg

SEQ ID NO: 548636 - DNA, 511 bp, Homo sapiens
  misc_feature: HIJSMM301D5I96.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctct

SEQ ID NO: 548637 - DNA, 515 bp, Homo sapiens
  misc_feature: HIJSMM301DFEV8.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaattttggtcatatgttgttcggcggagggaccaagctgaccgtcctcggtcagcccaaggctgccccctcggtcactctgttcccacctcct

SEQ ID NO: 548638 - DNA, 494 bp, Homo sapiens
  misc_feature: HIJSMM301AINKL.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacttcggccaagggaccaaggtggaaatgaaaggactagtggctgcaccatctgtctt

SEQ ID NO: 548639 - DNA, 444 bp, Homo sapiens; identical to SEQ ID NO: 535856
  misc_feature: HIJSMM301BYZRG.9.9.A09.1.454.light.4.raw

SEQ ID NO: 548640 - DNA, 443 bp, Homo sapiens
  misc_feature: HIJSMM301DBDBV.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttcccgcctcctccgtgtctgat

SEQ ID NO: 548641 - DNA, 505 bp, Homo sapiens; identical to SEQ ID NO: 536254
  misc_feature: HIJSMM301AT6CP.7.71.G05.1.454.light.4.raw

SEQ ID NO: 548642 - DNA, 473 bp, Homo sapiens
  misc_feature: HIJSMM301CQTVO.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgcttcctccgagtgccacttttggcggggggaccaaggtggacatcaaacgaa

SEQ ID NO: 548643 - DNA, 485 bp, Homo sapiens; identical to SEQ ID NO: 535648
  misc_feature: HIJSMM301DDN35.17.36.D03.1.454.light.4.raw

SEQ ID NO: 548644 - DNA, 472 bp, Homo sapiens; identical to SEQ ID NO: 536302
  misc_feature: HIJSMM301DNHGA.18.76.G10.1.454.light.4.raw

SEQ ID NO: 548645 - DNA, 501 bp, Homo sapiens
  misc_feature: HIJSMM301ED5K8.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatacaaacgaactagtggctgcaccatctgtcttcta

SEQ ID NO: 548646 - DNA, 487 bp, Homo sapiens; identical to SEQ ID NO: 548447
  misc_feature: HIJSMM301ARI7B.10.23.C01.1.454.light.4.raw

SEQ ID NO: 548647 - DNA, 492 bp, Homo sapiens
  misc_feature: HIJSMM301DJOLS.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactgtgg

SEQ ID NO: 548648 - DNA, 491 bp, Homo sapiens
  misc_feature: HIJSMM301B5NMM.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgccggggaccaagctggaaatcaagcgaactgtggctgcaccatctgtcttcatt

SEQ ID NO: 548649 - DNA, 420 bp, Homo sapiens; identical to SEQ ID NO: 540533
  misc_feature: HIJSMM301C5SB2.9.34.D01.1.454.light.4.raw

SEQ ID NO: 548650 - DNA, 518 bp, Homo sapiens
  misc_feature: HIJSMM301CYCEZ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagccaaggctgccccctcggtcactctgttcccacct

SEQ ID NO: 548651 - DNA, 477 bp, Homo sapiens
  misc_feature: HIJSMM301BDMF2.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccatgctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 548652 - DNA, 509 bp, Homo sapiens
  misc_feature: HIJSMM301CAI6E.9.12.B01.1.454.light.4.raw
tgatacgtctcacgaccggtgctcgatttagtagtgtagattccgcggggacaacaggcaggcaggggcgagcaagaatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtaccaagggaccaaggtaggaaagtcaaacgaactagtggctgcaccatctgtcttctatcttccccg

SEQ ID NO: 548653 - DNA, 514 bp, Homo sapiens
  misc_feature: HIJSMM301BDBMK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccaaggaccgaaggtacggaagtacgaaacgaactagtggctgcaccatctgtcttctactcttcccgtcccact

SEQ ID NO: 548654 - DNA, 505 bp, Homo sapiens; identical to SEQ ID NO: 535503
  misc_feature: HIJSMM301B275J.8.28.C06.1.454.light.4.raw

SEQ ID NO: 548655 - DNA, 479 bp, Homo sapiens
  misc_feature: HIJSMM301DEDGR.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactagtggctgcaccat

SEQ ID NO: 548656 - DNA, 498 bp, Homo sapiens
  misc_feature: HIJSMM301CFTW7.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaacgaactagtggctgcacc

SEQ ID NO: 548657 - DNA, 499 bp, Homo sapiens; identical to SEQ ID NO: 539754
  misc_feature: HIJSMM301CE8PQ.11.21.B10.1.454.light.4.raw

SEQ ID NO: 548658 - DNA, 487 bp, Homo sapiens; identical to SEQ ID NO: 540408
  misc_feature: HIJSMM301AOJM1.41.33.C11.1.454.light.4.raw

SEQ ID NO: 548659 - DNA, 497 bp, Homo sapiens; identical to SEQ ID NO: 535286
  misc_feature: HIJSMM301C1BZJ.18.59.F04.1.454.light.4.raw

SEQ ID NO: 548660 - DNA, 498 bp, Homo sapiens
  misc_feature: HIJSMM301EGMQL.43.71.G05.1.454.light.4.raw
tgtgagtagtcacgaccggtgctcgatttagtgtcgtcgcaagagagagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 548661 - DNA, 499 bp, Homo sapiens
  misc_feature: HIJSMM301A7R58.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtgctgcaccta

SEQ ID NO: 548662 - DNA, 502 bp, Homo sapiens
  misc_feature: HIJSMM301EPQZD.48.30.C08.1.454.light.4.raw
agtatacatacacgaccggtgctcgatttagtctgacgtcaaagggaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactagtggctgcaccatctgtcttcatcttcccgccta

SEQ ID NO: 548663 - DNA, 496 bp, Homo sapiens
  misc_feature: HIJSMM301DMWA7.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaa

SEQ ID NO: 548664 - DNA, 422 bp, Homo sapiens; identical to SEQ ID NO: 537797
  misc_feature: HIJSMM301BL6WM.9.34.D01.1.454.light.4.raw

SEQ ID NO: 548665 - DNA, 476 bp, Homo sapiens
  misc_feature: HIJSMM301CCXVS.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgtaacctgaagattctgcaacttattactgtcaacagagtaacagttaccctcccactttcggcggaggaccaaggtggagatcaaacgaactgtgctgcac

SEQ ID NO: 548666 - DNA, 502 bp, Homo sapiens
  misc_feature: HIJSMM301DBB0R.4.71.G05.1.454.light.4.raw
  modified_base (236)..(236): a, c, t, g, unknown or other
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggagggaccaaactgaccgtcctaggtcagcccaaggctgccccctcggtcactctgtt

SEQ ID NO: 548667 - DNA, 446 bp, Homo sapiens; identical to SEQ ID NO: 540475
  misc_feature: HIJSMM301DSFSY.18.9.A09.1.454.light.4.raw

SEQ ID NO: 548668 - DNA, 491 bp, Homo sapiens
  misc_feature: HIJSMM301DBZHM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggagagtcagacgaactgtggctgcaccatctgtcttcta

SEQ ID NO: 548669 - DNA, 494 bp, Homo sapiens; identical to SEQ ID NO: 534992
  misc_feature: HIJSMM301DQPJU.9.1.A01.1.454.light.4.raw

SEQ ID NO: 548670 - DNA, 445 bp, Homo sapiens
  misc_feature: HIJSMM301DFTC2.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactccctatgacaacagcctgagtatttggctgttcggcggcgggaccaagttgaccgtcctacgtcagcccaaggctgccccctcggtcactctgttcccgccctcctcgacacgcgag

SEQ ID NO: 548671 - DNA, 492 bp, Homo sapiens; identical to SEQ ID NO: 536087
  misc_feature: HIJSMM301DNL9V.10.17.B06.1.454.light.4.raw

SEQ ID NO: 548672 - DNA, 504 bp, Homo sapiens
  misc_feature: HIJSMM301C05VE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccgaaggtggaaagtcaaacgaactagtggctgcaccatctgtcttcatcttccccg

SEQ ID NO: 548673 - DNA, 507 bp, Homo sapiens
  misc_feature: HIJSMM301DZLTH.15.59.F04.1.454.light.4.raw
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctggt

SEQ ID NO: 548674 - DNA, 495 bp, Homo sapiens
  misc_feature: HIJSMM301BXJFQ.10.79.H02.1.454.light.4.raw
catagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccgaggggaccaagctggagatcaaacgaactgtggctgcaccatctgtctt

SEQ ID NO: 548675 - DNA, 507 bp, Homo sapiens; identical to SEQ ID NO: 538702
  misc_feature: HIJSMM301DBE6U.11.57.F02.1.454.light.4.raw

SEQ ID NO: 548676 - DNA, 504 bp, Homo sapiens
  misc_feature: HIJSMM301DGY10.15.66.F11.1.454.light.4.raw
tctacgtagccacgaccggtgctcgatttagtcacgcgagaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccatgtcactctgttcccaccct

SEQ ID NO: 548677 - DNA, 487 bp, Homo sapiens; identical to SEQ ID NO: 548447
  misc_feature: HIJSMM301BO98L.10.23.C01.1.454.light.4.raw

SEQ ID NO: 548678 - DNA, 497 bp, Homo sapiens; identical to SEQ ID NO: 535664
  misc_feature: HIJSMM301A2T18.22.14.B03.1.454.light.4.raw

SEQ ID NO: 548679 - DNA, 486 bp, Homo sapiens; identical to SEQ ID NO: 535385
  misc_feature: HIJSMM301DXLMO.19.71.G05.1.454.light.4.raw

SEQ ID NO: 548680 - DNA, 498 bp, Homo sapiens; identical to SEQ ID NO: 546411
  misc_feature: HIJSMM301BFZYB.48.59.F04.1.454.light.4.raw

SEQ ID NO: 548681 - DNA, 509 bp, Homo sapiens
  misc_feature: HIJSMM301DMHQZ.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 548682 - DNA, 492 bp, Homo sapiens
  misc_feature: HIJSMM301DV7NM.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccctcgtcgctc

SEQ ID NO: 548683 - DNA, 447 bp, Homo sapiens; identical to SEQ ID NO: 535020
  misc_feature: HIJSMM301B0P9M.18.9.A09.1.454.light.4.raw

SEQ ID NO: 548684 - DNA, 482 bp, Homo sapiens
  misc_feature: HIJSMM301B56L3.43.36.D03.1.454.light.4.raw
  modified_base (437)..(437): a, c, t, g, unknown or other
  modified_base (446)..(446): a, c, t, g, unknown or other
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcgtttattatgtcaacaatattttagngctccgtanacttttggccagggaccaagttggagatcaaacgaa

SEQ ID NO: 548685 - DNA, 363 bp, Homo sapiens
  misc_feature: HIJSMM301DR2KC.19.31.C09.1.454.light.4.raw
tactctcgtgcacgaccggtgctcgatttagacgtctcatcaaggaaggaaggggcagcaagatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcagaaaccaggacagcctcctaaggtgctcatttcctgggcatctacccgggaatccggggtccctgaccgattcagtggcagcgggtctgggacagatttcactctcagca

SEQ ID NO: 548686 - DNA, 508 bp, Homo sapiens
  misc_feature: HIJSMM301BAAJT.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggagggaccaaactgaccgtcctaggtcagcccaaggctgccccctcggtcactctgttccccg

SEQ ID NO: 548687 - DNA, 520 bp, Homo sapiens
  misc_feature: HIJSMM301BBI4S.43.45.E01.1.454.light.4.raw
tgtgagtagtcacgaccggtgctcgatttagtgagtcagtaagggaaaggggggcctgaggaagcagcactggtggtgcctcagccatggcctggaccgttctcctcctcggcctcctctctcactgcacaggctccgtgacctcctatgaactgactcagccccctcggtgtctgtggccccaggacagacggccagcattacctgtggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagtcgggtcgaggccggggacgaggccgactattattgtcaactgtgggatggtactggtgaccggtactgggtgttcggcggagggaccaagctgaccgtcctaggtcagcccaaggctcgccccctcggtcactctgttcccaccctcctcacta

SEQ ID NO: 548688 - DNA, 492 bp, Homo sapiens; identical to SEQ ID NO: 536087
  misc_feature: HIJSMM301B7K4J.10.17.B06.1.454.light.4.raw

SEQ ID NO: 548689 - DNA, 484 bp, Homo sapiens; identical to SEQ ID NO: 535240
  misc_feature: HIJSMM301CKW0M.47.60.F05.1.454.light.4.raw

SEQ ID NO: 548690 - DNA, 509 bp, Homo sapiens
  misc_feature: HIJSMM301E3H72.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctgttcccacctcctcgctacgtaga

SEQ ID NO: 548691 - DNA, 505 bp, Homo sapiens; identical to SEQ ID NO: 535987
  misc_feature: HIJSMM301CGRKB.18.37.D04.1.454.light.4.raw

SEQ ID NO: 548692 - DNA, 486 bp, Homo sapiens
  misc_feature: HIJSMM301BM22Z.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggggtttactactgcatgcagggtacactctggccgttcacttttggccaggggaccaaactggatatcagacgaactgtgg

SEQ ID NO: 548693 - DNA, 500 bp, Homo sapiens
  misc_feature: HIJSMM301CT42E.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctggagtgctgtggtcttcggcggagggaccaagctgaccgtcctgggtcagcccaa

SEQ ID NO: 548694 - DNA, 501 bp, Homo sapiens
  misc_feature: HIJSMM301DKUID.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtgggtccttatcgggtgttcgggcggggggaccaagctgaccgtcctaggtcagcccaaggctgccccctcggtcactctcg

SEQ ID NO: 548695 - DNA, 503 bp, Homo sapiens
  misc_feature: HIJSMM301CZCA6.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagccaaggctgccccctcggtcactctgttcccgccctcctctacgtcgtat

SEQ ID NO: 548696 - DNA, 444 bp, Homo sapiens; identical to SEQ ID NO: 535192
  misc_feature: HIJSMM301AJ9GE.5.9.A09.1.454.light.4.raw

SEQ ID NO: 548697 - DNA, 502 bp, Homo sapiens; identical to SEQ ID NO: 536253
  misc_feature: HIJSMM301BVYND.21.22.B11.1.454.light.4.raw

SEQ ID NO: 548698 - DNA, 493 bp, Homo sapiens
  misc_feature: HIJSMM301ENLQA.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccgagggtggaggatcagacgaactgtggctgcaccatctgtt

SEQ ID NO: 548699 - DNA, 492 bp, Homo sapiens; identical to SEQ ID NO: 536175
  misc_feature: HIJSMM301AHFL4.19.83.H06.1.454.light.4.raw

SEQ ID NO: 548700 - DNA, 495 bp, Homo sapiens; identical to SEQ ID NO: 539288
  misc_feature: HIJSMM301DY8NT.9.1.A01.1.454.light.4.raw

SEQ ID NO: 548701 - DNA, 475 bp, Homo sapiens
  misc_feature: HIJSMM301AD3IM.3.1.A01.1.454.light.4.raw
agacgcactccacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactagtggctgcaccat

SEQ ID NO: 548702 - DNA, 490 bp, Homo sapiens; identical to SEQ ID NO: 538273
  misc_feature: HIJSMM301EHXTQ.16.73.G07.1.454.light.4.raw

SEQ ID NO: 548703 - DNA, 502 bp, Homo sapiens
  misc_feature: HIJSMM301DD874.40.34.D01.1.454.light.4.raw
tctagcgactcacgaccggtgctcgatttagatcgtctgtgttgggtttggggagggctggtgggatcagtcctggtggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtccg

SEQ ID NO: 548704 - DNA, 488 bp, Homo sapiens; identical to SEQ ID NO: 536554
  misc_feature: HIJSMM301E0T5O.26.37.D04.1.454.light.4.raw

SEQ ID NO: 548705 - DNA, 447 bp, Homo sapiens; identical to SEQ ID NO: 535882
  misc_feature: HIJSMM301C1OQ1.18.9.A09.1.454.light.4.raw
  modified_base (429)..(429): a, c, t, g, unknown or other

SEQ ID NO: 548706 - DNA, 487 bp, Homo sapiens; identical to SEQ ID NO: 539440
  misc_feature: HIJSMM301DWB2A.8.12.B01.1.454.light.4.raw

SEQ ID NO: 548707 - DNA, 454 bp, Homo sapiens; identical to SEQ ID NO: 534964
  misc_feature: HIJSMM301C2PSQ.19.86.H09.1.454.light.4.raw

SEQ ID NO: 548708 - DNA, 479 bp, Homo sapiens; identical to SEQ ID NO: 537163
  misc_feature: HIJSMM301DQO9S.13.73.G07.1.454.light.4.raw

SEQ ID NO: 548709 - DNA, 488 bp, Homo sapiens; identical to SEQ ID NO: 542699
  misc_feature: HIJSMM301A4H47.12.51.E07.1.454.light.4.raw

SEQ ID NO: 548710 - DNA, 511 bp, Homo sapiens
  misc_feature: HIJSMM301A8OOI.53.79.H02.1.454.light.4.raw
cgcgtatacacacgaccggtgctcgatttagtgtcacacgaagggaaagggggctggggtcacaagaggcagcgctctcgggacgtctccaccatggcctgggctctgctgctcctcaccctcctcactcaggacacagggtcctgggcccagtctgccctgactcagcctgcctccgtctctgggtctcctggacagtcgatcaccatttcctgcactggaaccagcagtgatgttgggaattataaccttgtctcctggtaccaacaatacccaggcaaagcccccaaagtcataatttttgaggtcaataagcggccctctggggtttctgatcgcttctccggctccaagtctggcaacacggcctccctgacaatctctgggctccaggctgacgacgaggctgattattactgctgctcatatgcaggtaatcgtcgtttcgctgtgttcggaggaggcacccagctgaccgtcctcggtcagcccaaggctgccccctcggtca

SEQ ID NO: 548711 - DNA, 506 bp, Homo sapiens; identical to SEQ ID NO: 534969
  misc_feature: HIJSMM301AZ74O.18.37.D04.1.454.light.4.raw

SEQ ID NO: 548712 - DNA, 497 bp, Homo sapiens
  misc_feature: HIJSMM301DNG67.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgcccc

SEQ ID NO: 548713 - DNA, 501 bp, Homo sapiens
  misc_feature: HIJSMM301AWQBK.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggacgaacgtaggaagtcaagcgaactcgtggctgcaccaactctgtcttctact

SEQ ID NO: 548714 - DNA, 521 bp, Homo sapiens; identical to SEQ ID NO: 539470
  misc_feature: HIJSMM301EM9DK.27.23.C01.1.454.light.4.raw

SEQ ID NO: 548715 - DNA, 508 bp, Homo sapiens; identical to SEQ ID NO: 536062
  misc_feature: HIJSMM301BZEWQ.11.57.F02.1.454.light.4.raw

SEQ ID NO: 548716 - DNA, 485 bp, Homo sapiens; identical to SEQ ID NO: 535880
  misc_feature: HIJSMM301EAK4Q.7.75.G09.1.454.light.4.raw

SEQ ID NO: 548717 - DNA, 505 bp, Homo sapiens; identical to SEQ ID NO: 535987
  misc_feature: HIJSMM301AOGH1.18.37.D04.1.454.light.4.raw

SEQ ID NO: 548718 - DNA, 478 bp, Homo sapiens
  misc_feature: HIJSMM301AH1YS.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagacccg

SEQ ID NO: 548719 - DNA, 496 bp, Homo sapiens; identical to SEQ ID NO: 535109
  misc_feature: HIJSMM301BR1EJ.16.78.H01.1.454.light.4.raw

SEQ ID NO: 548720 - DNA, 498 bp, Homo sapiens
  misc_feature: HIJSMM301COYG1.51.80.H03.1.454.light.4.raw
cgatcgtatacacgaccggtgctcgatttagctgtgcgtcgaagggaaagggctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctggtccactctgttcccta

SEQ ID NO: 548721 - DNA, 500 bp, Homo sapiens
  misc_feature: HIJSMM301CXY2A.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccaagctggagatcaaacgaactgtggctgcacca

SEQ ID NO: 548722 - DNA, 503 bp, Homo sapiens; identical to SEQ ID NO: 538884
  misc_feature: HIJSMM301EEZHB.27.78.H01.1.454.light.4.raw

SEQ ID NO: 548723 - DNA, 483 bp, Homo sapiens; identical to SEQ ID NO: 544786
  misc_feature: HIJSMM301D0FGC.46.26.C04.1.454.light.4.raw

SEQ ID NO: 548724 - DNA, 510 bp, Homo sapiens
  misc_feature: HIJSMM301C7BIC.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggagtatacaaacgaactgtggctgcaccatctgtcttcta

SEQ ID NO: 548725 - DNA, 493 bp, Homo sapiens; identical to SEQ ID NO: 536246
  misc_feature: HIJSMM301AS82O.49.66.F11.1.454.light.4.raw

SEQ ID NO: 548726 - DNA, 487 bp, Homo sapiens; identical to SEQ ID NO: 536206
  misc_feature: HIJSMM301A748P.47.38.D05.1.454.light.4.raw

SEQ ID NO: 548727 - DNA, 497 bp, Homo sapiens; identical to SEQ ID NO: 535286
  misc_feature: HIJSMM301CLL1J.18.59.F04.1.454.light.4.raw

SEQ ID NO: 548728 - DNA, 482 bp, Homo sapiens
  misc_feature: HIJSMM301CXSCL.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 548729 - DNA, 496 bp, Homo sapiens; identical to SEQ ID NO: 535109
  misc_feature: HIJSMM301APR75.16.78.H01.1.454.light.4.raw

SEQ ID NO: 548730 - DNA, 491 bp, Homo sapiens; identical to SEQ ID NO: 535194
  misc_feature: HIJSMM301C89SS.26.78.H01.1.454.light.4.raw

SEQ ID NO: 548731 - DNA, 516 bp, Homo sapiens
  misc_feature: HIJSMM301CDSSY.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccaccctcctccc

SEQ ID NO: 548732 - DNA, 495 bp, Homo sapiens; identical to SEQ ID NO: 535007
  misc_feature: HIJSMM301CQTY7.22.5.A05.1.454.light.4.raw

SEQ ID NO: 548733 - DNA, 500 bp, Homo sapiens
  misc_feature: HIJSMM301C86NI.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtaggaggatccaaacgaaacctgtggctgcaccactctgtcttctat

SEQ ID NO: 548734 - DNA, 496 bp, Homo sapiens; identical to SEQ ID NO: 536248
  misc_feature: HIJSMM301AVW39.22.27.C05.1.454.light.4.raw

SEQ ID NO: 548735 - DNA, 482 bp, Homo sapiens
  misc_feature: HIJSMM301ES1FI.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtggaggatcaaacgaaactgtggctgcacc

SEQ ID NO: 548736 - DNA, 491 bp, Homo sapiens
  misc_feature: HIJSMM301A00V7.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgca

SEQ ID NO: 548737 - DNA, 493 bp, Homo sapiens
  misc_feature: HIJSMM301C0ZIJ.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggcagggacccaggtggaggatcagacgaactgtggctgcaccatctgtcttcatcttcccg

SEQ ID NO: 548738 - DNA, 500 bp, Homo sapiens
  misc_feature: HIJSMM301AE0LB.9.12.B01.1.454.light.4.raw
  modified_base (457)..(457): a, c, t, g, unknown or other
  modified_base (460)..(460): a, c, t, g, unknown or other
  modified_base (472)..(472): a, c, t, g, unknown or other
  modified_base (481)..(481): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagaatgtggcagtttattactgtcaacagttttctcgggcgtgtcgagacgagaggaagtanaanaacataggtcgngtcaccacnctgtcttctactcttcccg

SEQ ID NO: 548739 - DNA, 484 bp, Homo sapiens; identical to SEQ ID NO: 536395
  misc_feature: HIJSMM301EKOEI.46.35.D02.1.454.light.4.raw

SEQ ID NO: 548740 - DNA, 487 bp, Homo sapiens
  misc_feature: HIJSMM301C2LER.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 548741 - DNA, 502 bp, Homo sapiens
  misc_feature: HIJSMM301AHJYU.4.11.A11.1.454.light.4.raw
agcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtgggcctaccgatacgaaccgtgactaaggtccagccagagtcttttatacgggtccgacggtaagaattatttagcttggtatcagcaaaagccaggacagcctcctaagttgctcatttactgggcgactttccgtgattacggggtccctctccggttcagtggcggcgggtctgggacagacttcactctcaccatcgacagcctgcaggatgaagatgtggcagtctatttctgtcagcaatattatactactcccccggacattcggccaagggaccaaggtggagatcaagcgaactgtggctgcaccatctgtcttcatcttcccgccat

SEQ ID NO: 548742 - DNA, 482 bp, Homo sapiens; identical to SEQ ID NO: 538815
  misc_feature: HIJSMM301ASISV.4.34.D01.1.454.light.4.raw

SEQ ID NO: 548743 - DNA, 500 bp, Homo sapiens
  misc_feature: HIJSMM301EJP37.22.5.A05.1.454.light.4.raw
acatacgcgtcacgaccggtgctcgatttagatagatagacagggggagggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctgaccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgccatcc

SEQ ID NO: 548744 - DNA, 460 bp, Homo sapiens; identical to SEQ ID NO: 537107
  misc_feature: HIJSMM301AUWIQ.22.28.C06.1.454.light.4.raw

SEQ ID NO: 548745 - DNA, 520 bp, Homo sapiens; identical to SEQ ID NO: 540293
  misc_feature: HIJSMM301BFBM7.27.23.C01.1.454.light.4.raw

SEQ ID NO: 548746 - DNA, 506 bp, Homo sapiens
  misc_feature: HIJSMM301D49PU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggcgtgcaccatctgtcttcatcttccccg

SEQ ID NO: 548747 - DNA, 476 bp, Homo sapiens; identical to SEQ ID NO: 537368
  misc_feature: HIJSMM301D77DA.7.83.H06.1.454.light.4.raw

SEQ ID NO: 548748 - DNA, 499 bp, Homo sapiens
  misc_feature: HIJSMM301EMCKX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgtagtctgaagattttgcggtttattactgtcagcagtataataactggcctccacggtacacttttggccaggggaccaagctggagatcaaacgaactgtggctgcaccatctgtctt

SEQ ID NO: 548749 - DNA, 497 bp, Homo sapiens
  misc_feature: HIJSMM301DLTZW.3.10.A10.1.454.light.4.raw
agacgcactccacgaccggtgctcgatttagcgtcgatctcagggggctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcat

SEQ ID NO: 548750 - DNA, 491 bp, Homo sapiens
  misc_feature: HIJSMM301AWMP3.3.26.C04.1.454.light.4.raw
agacgcactccacgaccggtgctcgatttagtctagcgactttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaacgaactgtggctgcaccatctgtcttcta

SEQ ID NO: 548751 - DNA, 444 bp, Homo sapiens
  misc_feature: HIJSMM301EN5ND.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataaaaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctccactactatg

SEQ ID NO: 548752 - DNA, 508 bp, Homo sapiens
  misc_feature: HIJSMM301BVN1R.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttggggtgttcggcggagggaccaaggctgaccgttcg

SEQ ID NO: 548753 - DNA, 496 bp, Homo sapiens
  misc_feature: HIJSMM301BN303.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaaatagcctggaagctgaagatgctgcaacttattactgtcatcagagtactactttacctcaagtgatcaccttcggccaaggacacgaactggagattaaaacaactagtggctgcaccatctgtctt

SEQ ID NO: 548754 - DNA, 496 bp, Homo sapiens; identical to SEQ ID NO: 538394
  misc_feature: HIJSMM301DI2ZU.22.86.H09.1.454.light.4.raw

SEQ ID NO: 548755 - DNA, 494 bp, Homo sapiens
  misc_feature: HIJSMM301EZAQ7.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggcctctacgtttcggcggacgggaccgaaggtggagatacaaacgaacgt

SEQ ID NO: 548756 - DNA, 489 bp, Homo sapiens; identical to SEQ ID NO: 536013
  misc_feature: HIJSMM301BH7XO.26.23.C01.1.454.light.4.raw

SEQ ID NO: 548757 - DNA, 488 bp, Homo sapiens; identical to SEQ ID NO: 537124
  misc_feature: HIJSMM301C356M.11.25.C03.1.454.light.4.raw

SEQ ID NO: 548758 - DNA, 494 bp, Homo sapiens; identical to SEQ ID NO: 546323
  misc_feature: HIJSMM301E2V0L.51.59.F04.1.454.light.4.raw

SEQ ID NO: 548759 - DNA, 490 bp, Homo sapiens
  misc_feature: HIJSMM301AD2YC.49.59.F04.1.454.light.4.raw
agtcgagagacacgaccggtgctcgatttagtacacacacttagggattggggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtt

SEQ ID NO: 548760 - DNA, 463 bp, Homo sapiens; identical to SEQ ID NO: 535062
  misc_feature: HIJSMM301DF6NC.11.73.G07.1.454.light.4.raw

SEQ ID NO: 548761 - DNA, 503 bp, Homo sapiens; identical to SEQ ID NO: 535044
  misc_feature: HIJSMM301A3LN6.19.78.H01.1.454.light.4.raw

SEQ ID NO: 548762 - DNA, 498 bp, Homo sapiens
  misc_feature: HIJSMM301B1XU9.2.76.G10.1.454.light.4.raw
acgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctggaccaaggtcaccgtccttggt

SEQ ID NO: 548763 - DNA, 518 bp, Homo sapiens
  misc_feature: HIJSMM301CJ1GU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcggccaaggaccgaacggtaggaaggtacgaaacgaactacgtaggcgtgcgaccatctgtcttctactccttcccgtccact

SEQ ID NO: 548764 - DNA, 501 bp, Homo sapiens
  misc_feature: HIJSMM301B8GOF.43.27.C05.1.454.light.4.raw
tgtgagtagtcacgaccggtgctcgatttagacgcgatcgaagggtttggggctccaaacagagcttcagcaaggatagtgggattctgcaccatgcccagggctctgctcctcctgaccctcctcactcactctgcagtgtcagtggtccaggcaggactgactcagccaccctcggtgtccaagtaattgagacacaccgccacactcacctgcgctgggaacaacagtagtgtcgacaatcaaggagcagcttggctgctgcagttcaagagtcagggataacaaccggccctcagggatctcatagagactatctgcatccaggtcaggaaagacagcctccctgaccattactggactccggcctgaggacgagtctgaccattactgctcaccttggggcagtagtgtcaatactcggggtgttcggcggagggaccaaccggaccgtcctaggtcagcccaaggctgccccctcggtcactctgttcccaccct

SEQ ID NO: 548765 - DNA, 495 bp, Homo sapiens; identical to SEQ ID NO: 535007
  misc_feature: HIJSMM301DDSW3.22.5.A05.1.454.light.4.raw

SEQ ID NO: 548766 - DNA, 485 bp, Homo sapiens
  misc_feature: HIJSMM301ECNME.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtagctgcaccat

SEQ ID NO: 548767 - DNA, 483 bp, Homo sapiens
  misc_feature: HIJSMM301BS9F4.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcggacagtccaggatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccaggtggaaatacaaacgaactgtggctgcaccat

SEQ ID NO: 548768 - DNA, 497 bp, Homo sapiens
  misc_feature: HIJSMM301CPZ8Z.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcg

SEQ ID NO: 548769 - DNA, 497 bp, Homo sapiens; identical to SEQ ID NO: 548749
  misc_feature: HIJSMM301DJ65W.3.10.A10.1.454.light.4.raw

SEQ ID NO: 548770 - DNA, 489 bp, Homo sapiens; identical to SEQ ID NO: 535139
  misc_feature: HIJSMM301AKIGT.14.55.E11.1.454.light.4.raw

SEQ ID NO: 548771 - DNA, 494 bp, Homo sapiens; identical to SEQ ID NO: 535090
  misc_feature: HIJSMM301D5W70.27.78.H01.1.454.light.4.raw
  modified_base (403)..(403): a, c, t, g, unknown or other

SEQ ID NO: 548772 - DNA, 516 bp, Homo sapiens; identical to SEQ ID NO: 535549
  misc_feature: HIJSMM301B60T1.14.70.G04.1.454.light.4.raw

SEQ ID NO: 548773 - DNA, 499 bp, Homo sapiens
  misc_feature: HIJSMM301AOIKN.9.12.B01.1.454.light.4.raw
tgatacgtctcacgaccggtgctcgatttagtagtgtagattccgcagggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggtccaagggaccgaaggtggaaatacaaacgaaactagtggctgcaccatctgtcttcatt

SEQ ID NO: 548774 - DNA, 488 bp, Homo sapiens
  misc_feature: HIJSMM301ANB1L.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccaggggaccgaagctggagatcacaggaactgtggctgcacc

SEQ ID NO: 548775 - DNA, 488 bp, Homo sapiens; identical to SEQ ID NO: 543022
  misc_feature: HIJSMM301DXL0D.9.59.F04.1.454.light.4.raw

SEQ ID NO: 548776 - DNA, 489 bp, Homo sapiens
  misc_feature: HIJSMM301BLGT8.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccagggaccaagctggagaggaaacgaact

SEQ ID NO: 548777 - DNA, 492 bp, Homo sapiens; identical to SEQ ID NO: 536010
  misc_feature: HIJSMM301BW00Y.10.20.B09.1.454.light.4.raw

SEQ ID NO: 548778 - DNA, 512 bp, Homo sapiens; identical to SEQ ID NO: 542788
  misc_feature: HIJSMM301CFPO9.17.33.C11.1.454.light.4.raw

SEQ ID NO: 548779 - DNA, 454 bp, Homo sapiens; identical to SEQ ID NO: 535005
  misc_feature: HIJSMM301EPHR1.19.86.H09.1.454.light.4.raw

SEQ ID NO: 548780 - DNA, 497 bp, Homo sapiens
  misc_feature: HIJSMM301BSQVI.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactgaccgtcctaggtcagcccaaggctgccccctcggtcactcgttcccta

SEQ ID NO: 548781 - DNA, 517 bp, Homo sapiens
  misc_feature: HIJSMM301CKUY6.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccacctcctccacg

SEQ ID NO: 548782 - DNA, 500 bp, Homo sapiens
  misc_feature: HIJSMM301DAZ3M.52.36.D03.1.454.light.4.raw
  modified_base (493)..(493): a, c, t, g, unknown or other
cgcagtacgacacgaccggtgctcgatttagctgcgtcacgatctctcttggggtgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtccnctcttcg

SEQ ID NO: 548783 - DNA, 484 bp, Homo sapiens
  misc_feature: HIJSMM301EVNLD.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactagtggctgcaccatctgtcttcta

SEQ ID NO: 548784 - DNA, 489 bp, Homo sapiens
  misc_feature: HIJSMM301CTWGM.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaca

SEQ ID NO: 548785 - DNA, 486 bp, Homo sapiens; identical to SEQ ID NO: 535043
  misc_feature: HIJSMM301BCHXG.46.35.D02.1.454.light.4.raw

SEQ ID NO: 548786 - DNA, 415 bp, Homo sapiens; identical to SEQ ID NO: 536482
  misc_feature: HIJSMM301B4H5N.16.46.E02.1.454.light.4.raw

SEQ ID NO: 548787 - DNA, 447 bp, Homo sapiens; identical to SEQ ID NO: 535201
  misc_feature: HIJSMM301C1771.18.9.A09.1.454.light.4.raw

SEQ ID NO: 548788 - DNA, 491 bp, Homo sapiens
  misc_feature: HIJSMM301DH1AT.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggagggaccaacgtggaggtcaaacgaactgtggctgcacatctgt

SEQ ID NO: 548789 - DNA, 494 bp, Homo sapiens; identical to SEQ ID NO: 534994
  misc_feature: HIJSMM301DG76Q.27.78.H01.1.454.light.4.raw

SEQ ID NO: 548790 - DNA, 485 bp, Homo sapiens; identical to SEQ ID NO: 535501
  misc_feature: HIJSMM301AE5R5.3.10.A10.1.454.light.4.raw

SEQ ID NO: 548791 - DNA, 361 bp, Homo sapiens; identical to SEQ ID NO: 538948
  misc_feature: HIJSMM301BME24.3.57.F02.1.454.light.4.raw

SEQ ID NO: 548792 - DNA, 485 bp, Homo sapiens; identical to SEQ ID NO: 536307
  misc_feature: HIJSMM301A6YMW.46.35.D02.1.454.light.4.raw

SEQ ID NO: 548793 - DNA, 485 bp, Homo sapiens; identical to SEQ ID NO: 535648
  misc_feature: HIJSMM301C5IKP.17.36.D03.1.454.light.4.raw

SEQ ID NO: 548794 - DNA, 514 bp, Homo sapiens
  misc_feature: HIJSMM301ENE7S.48.57.F02.1.454.light.4.raw
agtatacatacacgaccggtgctcgatttagctcgatatagttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtca

SEQ ID NO: 548795 - DNA, 472 bp, Homo sapiens; identical to SEQ ID NO: 536302
  misc_feature: HIJSMM301A49E8.18.76.G10.1.454.light.4.raw

SEQ ID NO: 548796 - DNA, 472 bp, Homo sapiens
  misc_feature: HIJSMM301DM02U.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccagggacgaagctggagatcgaacgaactgtggctgcaccatctgtcttcatcttcccgccatctgagacacgcgag

SEQ ID NO: 548797 - DNA, 522 bp, Homo sapiens
  misc_feature: HIJSMM301DWXIQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccaccct

SEQ ID NO: 548798 - DNA, 506 bp, Homo sapiens
  misc_feature: HIJSMM301AVFH9.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagatttcactctgaccatcagcagcctgcaggctgaagatgtggcagtttattactgtcagcactgttttggcggttctccgactttcggcggagggaccgaaggtaggaggtacgaaacgaactgtggctgcaccatctgtctt

SEQ ID NO: 548799 - DNA, 505 bp, Homo sapiens; identical to SEQ ID NO: 535987
  misc_feature: HIJSMM301AG8TH.18.37.D04.1.454.light.4.raw

SEQ ID NO: 548800 - DNA, 494 bp, Homo sapiens; identical to SEQ ID NO: 534992
  misc_feature: HIJSMM301CORT8.9.1.A01.1.454.light.4.raw

SEQ ID NO: 548801 - DNA, 501 bp, Homo sapiens; identical to SEQ ID NO: 536867
  misc_feature: HIJSMM301BGU7M.5.86.H09.1.454.light.4.raw

SEQ ID NO: 548802 - DNA, 488 bp, Homo sapiens
  misc_feature: HIJSMM301A7D20.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttctgaactgggaccaaggtcaccgtcctaggtcagcccaaggccaacccactgtcact

SEQ ID NO: 548803 - DNA, 485 bp, Homo sapiens; identical to SEQ ID NO: 536576
  misc_feature: HIJSMM301BJ7Q5.46.35.D02.1.454.light.4.raw

SEQ ID NO: 548804 - DNA, 510 bp, Homo sapiens
  misc_feature: HIJSMM301B4Q3Z.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 548805 - DNA, 495 bp, Homo sapiens
  misc_feature: HIJSMM301EROCA.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagttggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 548806 - DNA, 497 bp, Homo sapiens; identical to SEQ ID NO: 545786
  misc_feature: HIJSMM301DEOYG.48.59.F04.1.454.light.4.raw

SEQ ID NO: 548807 - DNA, 497 bp, Homo sapiens; identical to SEQ ID NO: 536371
  misc_feature: HIJSMM301CDMLH.16.78.H01.1.454.light.4.raw

SEQ ID NO: 548808 - DNA, 509 bp, Homo sapiens; identical to SEQ ID NO: 539269
  misc_feature: HIJSMM301DRJVP.4.57.F02.1.454.light.4.raw

SEQ ID NO: 548809 - DNA, 489 bp, Homo sapiens; identical to SEQ ID NO: 535139
  misc_feature: HIJSMM301EE636.14.55.E11.1.454.light.4.raw

SEQ ID NO: 548810 - DNA, 516 bp, Homo sapiens
  misc_feature: HIJSMM301EF16O.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccaacggtaggaaagtacaagacgaacgtacgtaggcgtgcgaccaactactcgtcttctactcttccgt

SEQ ID NO: 548811 - DNA, 464 bp, Homo sapiens; identical to SEQ ID NO: 536640
  misc_feature: HIJSMM301B8JZU.26.78.H01.1.454.light.4.raw

SEQ ID NO: 548812 - DNA, 484 bp, Homo sapiens
  misc_feature: HIJSMM301DTIPX.5.55.E11.1.454.light.4.raw
atcagacacgcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttatactgtcagcaatattttattactcctctgacgttcgccaaggaccaaggtggaaatacaaacgaa

SEQ ID NO: 548813 - DNA, 499 bp, Homo sapiens
  misc_feature: HIJSMM301ASPFL.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccagggggaccaaggttgaagtcaaacgaactgtggctgcaccatctgtcttcat

SEQ ID NO: 548814 - DNA, 503 bp, Homo sapiens
  misc_feature: HIJSMM301BT08J.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtcctgggtcagcccaaggctgccccctcggtcta

SEQ ID NO: 548815 - DNA, 492 bp, Homo sapiens
  misc_feature: HIJSMM301BTDQN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcatt

SEQ ID NO: 548816 - DNA, 505 bp, Homo sapiens
  misc_feature: HIJSMM301EUP5L.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggccccaagtctggcaacacggcctccctgaccatctctgggctccaggctgatgacgaggctgattattactgcaggtcatatacaatcagcaacacttatgtcttcgggactgggaccaagatcaccgtcctaggtcacgcccaaggccaaccccactgtcact

SEQ ID NO: 548817 - DNA, 501 bp, Homo sapiens
  misc_feature: HIJSMM301B67KX.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcccgcagcctgaagattttgcaacttactattgtcaacaggctgacaggttcccgctgactttcggcggagggaccaaggtagagatcaaaggaactgtggctgcaccatctgtcttcatcttcccgccat

SEQ ID NO: 548818 - DNA, 511 bp, Homo sapiens
  misc_feature: HIJSMM301DUBII.40.53.E09.1.454.light.4.raw
tctagcgactcacgaccggtgctcgatttagagagagtgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 548819 - DNA, 486 bp, Homo sapiens; identical to SEQ ID NO: 535043
  misc_feature: HIJSMM301AYB0N.46.35.D02.1.454.light.4.raw

SEQ ID NO: 548820 - DNA, 507 bp, Homo sapiens
  misc_feature: HIJSMM301ENKVC.41.27.C05.1.454.light.4.raw
tctatactatcacgaccggtgctcgatttagacgcgatcgaagggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctaggtcagcccaaggctgccccctcggtcactctgttcccgccct

SEQ ID NO: 548821 - DNA, 464 bp, Homo sapiens; identical to SEQ ID NO: 537214
  misc_feature: HIJSMM301CJGRI.18.59.F04.1.454.light.4.raw

SEQ ID NO: 548822 - DNA, 489 bp, Homo sapiens
  misc_feature: HIJSMM301AYJWV.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 548823 - DNA, 494 bp, Homo sapiens; identical to SEQ ID NO: 534992
  misc_feature: HIJSMM301EON7V.9.1.A01.1.454.light.4.raw

SEQ ID NO: 548824 - DNA, 499 bp, Homo sapiens; identical to SEQ ID NO: 537857
  misc_feature: HIJSMM301D9NXR.52.34.D01.1.454.light.4.raw

SEQ ID NO: 548825 - DNA, 494 bp, Homo sapiens; identical to SEQ ID NO: 534992
  misc_feature: HIJSMM301CYJO0.9.1.A01.1.454.light.4.raw

SEQ ID NO: 548826 - DNA, 497 bp, Homo sapiens
  misc_feature: HIJSMM301BM7QL.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgccccctcggtcactcttcg

SEQ ID NO: 548827 - DNA, 477 bp, Homo sapiens; identical to SEQ ID NO: 537453
  misc_feature: HIJSMM301DQKSA.8.85.H08.1.454.light.4.raw

SEQ ID NO: 548828 - DNA, 497 bp, Homo sapiens
  misc_feature: HIJSMM301E2QEN.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctgactgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttcta

SEQ ID NO: 548829 - DNA, 496 bp, Homo sapiens
  misc_feature: HIJSMM301BSQMY.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccta

SEQ ID NO: 548830 - DNA, 488 bp, Homo sapiens; identical to SEQ ID NO: 537260
  misc_feature: HIJSMM301DW8K0.47.70.G04.1.454.light.4.raw

SEQ ID NO: 548831 - DNA, 494 bp, Homo sapiens; identical to SEQ ID NO: 534992
  misc_feature: HIJSMM301BF8E1.9.1.A01.1.454.light.4.raw

SEQ ID NO: 548832 - DNA, 489 bp, Homo sapiens
  misc_feature: HIJSMM301APY7M.49.73.G07.1.454.light.4.raw
agtcgagagacacgaccggtgctcgatttagctctacgctcagggcacgaccggtgctcgatttagtgtagtgtgaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtgg

SEQ ID NO: 548833 - DNA, 479 bp, Homo sapiens
  misc_feature: HIJSMM301CS07Y.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctccgagtagtaca

SEQ ID NO: 548834 - DNA, 511 bp, Homo sapiens
  misc_feature: HIJSMM301BRVAG.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattatgtcaggtgtggtatttcagtagtattcatccgggggttttcgcggagggaccaagctgaccgtcctaggtcagcccaaggctgccccctcggtcactctgttcccg

SEQ ID NO: 548835 - DNA, 508 bp, Homo sapiens
  misc_feature: HIJSMM301AYVGE.4.21.B10.1.454.light.4.raw
agcactgtagcacgaccggtgctcgatttagtgtcgtcgcaagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactcttcg

SEQ ID NO: 548836 - DNA, 444 bp, Homo sapiens; identical to SEQ ID NO: 535192
  misc_feature: HIJSMM301BA8OU.5.9.A09.1.454.light.4.raw

SEQ ID NO: 548837 - DNA, 485 bp, Homo sapiens
  misc_feature: HIJSMM301BLPYM.47.60.F05.1.454.light.4.raw
agctcacgtacacgaccggtgctcgatttagtacgtcatcagggaaagggggagggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 548838 - DNA, 509 bp, Homo sapiens
  misc_feature: HIJSMM301ASSP2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaagggaccgaaggtaggaaagtacaaacgaactagtggctgcaccatctgtcttcatcttccccg

SEQ ID NO: 548839 - DNA, 494 bp, Homo sapiens; identical to SEQ ID NO: 534992
  misc_feature: HIJSMM301BBEQ7.9.1.A01.1.454.light.4.raw

SEQ ID NO: 548840 - DNA, 495 bp, Homo sapiens
  misc_feature: HIJSMM301DB038.49.66.F11.1.454.light.4.raw
agtcgagagacacgaccggtgctcgatttagtcacgcgagaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccgt

SEQ ID NO: 548841 - DNA, 487 bp, Homo sapiens; identical to SEQ ID NO: 536536
  misc_feature: HIJSMM301D1NET.26.45.E01.1.454.light.4.raw

SEQ ID NO: 548842 - DNA, 494 bp, Homo sapiens; identical to SEQ ID NO: 535276
  misc_feature: HIJSMM301DZIGE.16.6.A06.1.454.light.4.raw

SEQ ID NO: 548843 - DNA, 501 bp, Homo sapiens
  misc_feature: HIJSMM301CO8LW.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcttggt

SEQ ID NO: 548844 - DNA, 517 bp, Homo sapiens
  misc_feature: HIJSMM301DV8BW.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcggggggaccacactgaccgtcctaggtcagcccaaggctgccccctcggtcactctgttccccg

SEQ ID NO: 548845 - DNA, 479 bp, Homo sapiens
  misc_feature: HIJSMM301CZYPJ.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctgattattactgctgctcatatgcaggcagctacacttgggtgttcggcggagggaccaagctgaccgtcctaggtcac

SEQ ID NO: 548846 - DNA, 487 bp, Homo sapiens; identical to SEQ ID NO: 536206
  misc_feature: HIJSMM301DEWY4.47.38.D05.1.454.light.4.raw

SEQ ID NO: 548847 - DNA, 490 bp, Homo sapiens; identical to SEQ ID NO: 535526
  misc_feature: HIJSMM301D9YUX.26.78.H01.1.454.light.4.raw

SEQ ID NO: 548848 - DNA, 487 bp, Homo sapiens; identical to SEQ ID NO: 536196
  misc_feature: HIJSMM301AS4AU.11.28.C06.1.454.light.4.raw

SEQ ID NO: 548849 - DNA, 486 bp, Homo sapiens; identical to SEQ ID NO: 535043
  misc_feature: HIJSMM301DHMJ1.46.35.D02.1.454.light.4.raw

SEQ ID NO: 548850 - DNA, 504 bp, Homo sapiens; identical to SEQ ID NO: 535561
  misc_feature: HIJSMM301BI4Z9.4.57.F02.1.454.light.4.raw

SEQ ID NO: 548851 - DNA, 499 bp, Homo sapiens
  misc_feature: HIJSMM301ASDHU.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccagggggaccaagctggagatcaaacgaactgtggctgcaccatctgtcttcatcttccccg

SEQ ID NO: 548852 - DNA, 434 bp, Homo sapiens; identical to SEQ ID NO: 535153
  misc_feature: HIJSMM301DHSXC.18.5.A05.1.454.light.4.raw

SEQ ID NO: 548853 - DNA, 502 bp, Homo sapiens
  misc_feature: HIJSMM301BYERC.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcaggaccatggcagtgggagcaacttcggggtgttcggcggagggaccaagctgaccgtctaggtcagcccg

SEQ ID NO: 548854 - DNA, 497 bp, Homo sapiens; identical to SEQ ID NO: 536371
  misc_feature: HIJSMM301C9KNS.16.78.H01.1.454.light.4.raw

SEQ ID NO: 548855 - DNA, 494 bp, Homo sapiens
  misc_feature: HIJSMM301CBO31.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccaaggccaacccactgtcact

SEQ ID NO: 548856 - DNA, 494 bp, Homo sapiens
  misc_feature: HIJSMM301CXEB6.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaaccca

SEQ ID NO: 548857 - DNA, 477 bp, Homo sapiens
  misc_feature: HIJSMM301DFKO4.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatcgtgggacagtattttaatttcaccatcagcagcctccaacgtgatgatgttgcaacatactattgtcagcaatatgtattttgctcctccgagtgcctacttttgggcgggggaccaaggtggacatacaaacgaa

SEQ ID NO: 548858 - DNA, 505 bp, Homo sapiens; identical to SEQ ID NO: 536117
  misc_feature: HIJSMM301CH5K9.8.71.G05.1.454.light.4.raw

SEQ ID NO: 548859 - DNA, 491 bp, Homo sapiens
  misc_feature: HIJSMM301BWB17.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggagggaccaaggtggagatcaaacgaactgtggctgcaccatctgtcttcatcttcccgccat

SEQ ID NO: 548860 - DNA, 454 bp, Homo sapiens; identical to SEQ ID NO: 535005
  misc_feature: HIJSMM301DF8EA.19.86.H09.1.454.light.4.raw

SEQ ID NO: 548861 - DNA, 489 bp, Homo sapiens; identical to SEQ ID NO: 536013
  misc_feature: HIJSMM301DTOIV.26.23.C01.1.454.light.4.raw

SEQ ID NO: 548862 - DNA, 497 bp, Homo sapiens
  misc_feature: HIJSMM301CYL1A.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcggtcact

SEQ ID NO: 548863 - DNA, 493 bp, Homo sapiens; identical to SEQ ID NO: 537281
  misc_feature: HIJSMM301DQNZI.9.1.A01.1.454.light.4.raw

SEQ ID NO: 548864 - DNA, 489 bp, Homo sapiens
  misc_feature: HIJSMM301C37U9.21.4.A04.1.454.light.4.raw
tcgtcgctcgcacgaccggtgctcgatttagagtagtgatcaggggaagagctgctcaggttaggacccagagggaaccatggaaaccccagcgcagcttctcttcctcctgctactctggctcccaggctcagaaaccaccggagaaattgtgttgacgcagtctccaggcaccctgtctttgtctccaggggaaagagtccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 548865 - DNA, 507 bp, Homo sapiens
  misc_feature: HIJSMM301BOMRY.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgtatactccgccgacgttcggccggggaccgaccgtggaaatcaaacgaactgtggctgcaccatctgtctt

SEQ ID NO: 548866 - DNA, 447 bp, Homo sapiens; identical to SEQ ID NO: 535201
  misc_feature: HIJSMM301E2NHS.18.9.A09.1.454.light.4.raw

SEQ ID NO: 548867 - DNA, 491 bp, Homo sapiens; identical to SEQ ID NO: 535294
  misc_feature: HIJSMM301CT4I1.16.68.G02.1.454.light.4.raw

SEQ ID NO: 548868 - DNA, 502 bp, Homo sapiens; identical to SEQ ID NO: 536604
  misc_feature: HIJSMM301ELZAA.27.78.H01.1.454.light.4.raw

SEQ ID NO: 548869 - DNA, 383 bp, Homo sapiens; identical to SEQ ID NO: 447524
  misc_feature: HIJSMM301DP0HZ.41.26.C04.1.454.light.4.raw

SEQ ID NO: 548870 - DNA, 494 bp, Homo sapiens; identical to SEQ ID NO: 535713
  misc_feature: HIJSMM301CLF24.49.6.A06.1.454.light.4.raw

SEQ ID NO: 548871 - DNA, 508 bp, Homo sapiens
  misc_feature: HIJSMM301AED8I.16.53.E09.1.454.light.4.raw
  modified_base (479)..(479): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatacagcagagtggaggctgaggatgttggggtttattactgcatgcaagctctacaaactaccttactacttttggtccgacggggaccgaancgtggaggatacaaacgaaactgtggtcg

SEQ ID NO: 548872 - DNA, 487 bp, Homo sapiens; identical to SEQ ID NO: 536196
  misc_feature: HIJSMM301AIMPZ.11.28.C06.1.454.light.4.raw

SEQ ID NO: 548873 - DNA, 502 bp, Homo sapiens; identical to SEQ ID NO: 537816
  misc_feature: HIJSMM301ETBZG.19.78.H01.1.454.light.4.raw

SEQ ID NO: 548874 - DNA, 510 bp, Homo sapiens; identical to SEQ ID NO: 535474
  misc_feature: HIJSMM301AK8R9.17.33.C11.1.454.light.4.raw

SEQ ID NO: 548875 - DNA, 515 bp, Homo sapiens
  misc_feature: HIJSMM301EW50A.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaggacgaacggtaggaaggtacgaaacgaactagtggcgtgcgaccactctgtcttctatcttcccgtcccact

SEQ ID NO: 548876 - DNA, 473 bp, Homo sapiens; identical to SEQ ID NO: 535262
  misc_feature: HIJSMM301BZPR5.8.67.G01.1.454.light.4.raw

SEQ ID NO: 548877 - DNA, 454 bp, Homo sapiens; identical to SEQ ID NO: 536943
  misc_feature: HIJSMM301A2BRD.19.86.H09.1.454.light.4.raw

SEQ ID NO: 548878 - DNA, 483 bp, Homo sapiens; identical to SEQ ID NO: 541577
  misc_feature: HIJSMM301BVVMC.47.60.F05.1.454.light.4.raw

SEQ ID NO: 548879 - DNA, 494 bp, Homo sapiens; identical to SEQ ID NO: 534994
  misc_feature: HIJSMM301CMO1L.27.78.H01.1.454.light.4.raw

SEQ ID NO: 548880 - DNA, 511 bp, Homo sapiens
  misc_feature: HIJSMM301BRLEF.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagtccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 548881 - DNA, 499 bp, Homo sapiens
  misc_feature: HIJSMM301AF2LU.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcgtccacggacgaacggtaggaaggtacgaaacgaactagtggcgtgtcgaccactctgtctt

SEQ ID NO: 548882 - DNA, 486 bp, Homo sapiens
  misc_feature: HIJSMM301EEXS3.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaaggctgaccgtcctgcgtcagcccaaggctgccccctcggtcactctgttcccaccctcctcgctacgtaga

SEQ ID NO: 548883 - DNA, 373 bp, Homo sapiens; identical to SEQ ID NO: 539301
  misc_feature: HIJSMM301BBHJB.21.25.C03.1.454.light.4.raw

SEQ ID NO: 548884 - DNA, 510 bp, Homo sapiens
  misc_feature: HIJSMM301AUGNR.52.41.D08.1.454.light.4.raw
cgcagtacgacacgaccggtgctcgatttagtcacgcgagaaagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgttctgggtcagcccaaggctgccccctc

SEQ ID NO: 548885 - DNA, 523 bp, Homo sapiens
  misc_feature: HIJSMM301EYTA4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacaaacgaactagtggcgtgcaccactactcgtcttctactcttccccgtccctact

SEQ ID NO: 548886 - DNA, 514 bp, Homo sapiens; identical to SEQ ID NO: 547648
  misc_feature: HIJSMM301A0JLP.16.1.A01.1.454.light.4.raw

SEQ ID NO: 548887 - DNA, 521 bp, Homo sapiens
  misc_feature: HIJSMM301CIGBC.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtcg

SEQ ID NO: 548888 - DNA, 502 bp, Homo sapiens
  misc_feature: HIJSMM301CXQ3W.15.86.H09.1.454.light.4.raw
  modified_base (500)..(500): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctggtcactctgttcccgccctccncg

SEQ ID NO: 548889 - DNA, 496 bp, Homo sapiens; identical to SEQ ID NO: 538149
  misc_feature: HIJSMM301BPZ8M.13.67.G01.1.454.light.4.raw

SEQ ID NO: 548890 - DNA, 494 bp, Homo sapiens
  misc_feature: HIJSMM301DH2FQ.52.54.E10.1.454.light.4.raw
cgcagtacgacacgaccggtgctcgatttagatcgtagcagaacacacaaaggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtgatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctc

SEQ ID NO: 548891 - DNA, 444 bp, Homo sapiens
  misc_feature: HIJSMM301DYK06.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtcccgtgaccgattctctggttccttgtctgacacctcagcctccctggccatcactgggctccagcctgaggatgaggctgattattactgtcagtcctttgacatttaaactggatgtggtattcggcggagggacccacgtaaccgtcctaggtcagcccaaggctgccccctccggtcactctgttcccgccctcctcgtatctctcg

SEQ ID NO: 548892 - DNA, 493 bp, Homo sapiens; identical to SEQ ID NO: 535657
  misc_feature: HIJSMM301BPIK4.27.78.H01.1.454.light.4.raw

SEQ ID NO: 548893 - DNA, 505 bp, Homo sapiens; identical to SEQ ID NO: 538422
  misc_feature: HIJSMM301D0FT8.19.78.H01.1.454.light.4.raw

SEQ ID NO: 548894 - DNA, 484 bp, Homo sapiens; identical to SEQ ID NO: 535400
  misc_feature: HIJSMM301B3HD2.46.26.C04.1.454.light.4.raw

SEQ ID NO: 548895 - DNA, 498 bp, Homo sapiens
  misc_feature: HIJSMM301D04CR.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcaca

SEQ ID NO: 548896 - DNA, 496 bp, Homo sapiens
  misc_feature: HIJSMM301BIMCZ.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccg

SEQ ID NO: 548897 - DNA, 497 bp, Homo sapiens
  misc_feature: HIJSMM301CO1VL.22.27.C05.1.454.light.4.raw
  modified_base (436)..(436): a, c, t, g, unknown or other
acatacgcgtcacgaccggtgctcgatttagacgcgatcgaagggtttggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattaaatnttcctcctcagacgttcggccaagggaccaaggtggaaatcaaacgaactgtggctgcacc

SEQ ID NO: 548898 - DNA, 444 bp, Homo sapiens; identical to SEQ ID NO: 535027
  misc_feature: HIJSMM301AFESM.8.73.G07.1.454.light.4.raw

SEQ ID NO: 548899 - DNA, 518 bp, Homo sapiens
  misc_feature: HIJSMM301DH5PT.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 548900 - DNA, 514 bp, Homo sapiens
  misc_feature: HIJSMM301DNWPF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgtaacgggaccgaaggtaggaaagtacaaacgaaactacgtggctgcaccatctgtcttctactcttccccg

SEQ ID NO: 548901 - DNA, 454 bp, Homo sapiens; identical to SEQ ID NO: 534964
  misc_feature: HIJSMM301AN8YJ.19.86.H09.1.454.light.4.raw

SEQ ID NO: 548902 - DNA, 519 bp, Homo sapiens
  misc_feature: HIJSMM301C5ZLL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccacct

SEQ ID NO: 548903 - DNA, 518 bp, Homo sapiens
  misc_feature: HIJSMM301AW8Z6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtacgaaacgaactacgtggctgcgaccatctgtcttctatcttcccgtccact

SEQ ID NO: 548904 - DNA, 506 bp, Homo sapiens; identical to SEQ ID NO: 539926
  misc_feature: HIJSMM301B88D8.5.24.C02.1.454.light.4.raw

SEQ ID NO: 548905 - DNA, 485 bp, Homo sapiens
  misc_feature: HIJSMM301AGJ27.51.40.D07.1.454.light.4.raw
cgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcacca

SEQ ID NO: 548906 - DNA, 495 bp, Homo sapiens; identical to SEQ ID NO: 545507
  misc_feature: HIJSMM301EK6O7.49.22.B11.1.454.light.4.raw

SEQ ID NO: 548907 - DNA, 495 bp, Homo sapiens
  misc_feature: HIJSMM301DFXOH.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtggacagctcacttcccgttatgtcttcggaggtgggaccatggtcaccgtcctaggtcagcccaagaccaaccccactgt

SEQ ID NO: 548908 - DNA, 447 bp, Homo sapiens; identical to SEQ ID NO: 535020
  misc_feature: HIJSMM301D9CJP.18.9.A09.1.454.light.4.raw

SEQ ID NO: 548909 - DNA, 478 bp, Homo sapiens
  misc_feature: HIJSMM301CADB0.4.74.G08.1.454.light.4.raw
  modified_base (457)..(457): a, c, t, g, unknown or other
  modified_base (471)..(471): a, c, t, g, unknown or other
  modified_base (476)..(476): a, c, t, g, unknown or other
agcactgtagcacgaccggtgctcgatttagtagctctatcgagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacactaccctggacgtgtcgacggacgaacgtaggaagtanaacaacgaactagngtcgnca

SEQ ID NO: 548910 - DNA, 487 bp, Homo sapiens
  misc_feature: HIJSMM301EKD07.43.28.C06.1.454.light.4.raw
tgtgagtagtcacgaccggtgctcgatttagagctcacgtattgggtttggggtgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtacttgaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaa

SEQ ID NO: 548911 - DNA, 454 bp, Homo sapiens; identical to SEQ ID NO: 535005
  misc_feature: HIJSMM301EKE00.19.86.H09.1.454.light.4.raw

SEQ ID NO: 548912 - DNA, 504 bp, Homo sapiens; identical to SEQ ID NO: 538521
  misc_feature: HIJSMM301BOUZJ.9.12.B01.1.454.light.4.raw

SEQ ID NO: 548913 - DNA, 486 bp, Homo sapiens; identical to SEQ ID NO: 535043
  misc_feature: HIJSMM301CSORW.46.35.D02.1.454.light.4.raw

SEQ ID NO: 548914 - DNA, 484 bp, Homo sapiens; identical to SEQ ID NO: 535400
  misc_feature: HIJSMM301DJR22.46.26.C04.1.454.light.4.raw

SEQ ID NO: 548915 - DNA, 468 bp, Homo sapiens
  misc_feature: HIJSMM301AK3HQ.48.69.G03.1.454.light.4.raw
agtatacatacacgaccggtgctcgatttagtcgctgcgtaaaggagaaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 548916 - DNA, 486 bp, Homo sapiens; identical to SEQ ID NO: 536323
  misc_feature: HIJSMM301C1ITE.10.2.A02.1.454.light.4.raw

SEQ ID NO: 548917 - DNA, 493 bp, Homo sapiens
  misc_feature: HIJSMM301AGVT9.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcgccgaacggaccgacgggtggaagtacaaacgaactagtggcgtgcgaccactcttcg

SEQ ID NO: 548918 - DNA, 504 bp, Homo sapiens; identical to SEQ ID NO: 535561
  misc_feature: HIJSMM301CIAUY.4.57.F02.1.454.light.4.raw

SEQ ID NO: 548919 - DNA, 493 bp, Homo sapiens; identical to SEQ ID NO: 541469
  misc_feature: HIJSMM301DU7C2.5.57.F02.1.454.light.4.raw

SEQ ID NO: 548920 - DNA, 493 bp, Homo sapiens
  misc_feature: HIJSMM301B2HOU.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccgaaggtggagatacaaacgaactgtggctgcaccatctgtt

SEQ ID NO: 548921 - DNA, 490 bp, Homo sapiens
  misc_feature: HIJSMM301BQUHW.47.78.H01.1.454.light.4.raw
agctcacgtacacgaccggtgctcgatttagtgtgagtagtttggggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggcccatcagtggggctccggtccgaggatgagggctgatttattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 548922 - DNA, 484 bp, Homo sapiens
  misc_feature: HIJSMM301BU2F6.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttatactgtcagcaatattatagtactcctccgaggctcactttcggcggagggaccaaggtggagatcaaacgaa

SEQ ID NO: 548923 - DNA, 505 bp, Homo sapiens
  misc_feature: HIJSMM301EAUNV.8.21.B10.1.454.light.4.raw
ctcgcgtgtccacgaccggtgctcgatttagtgtcgtcgcaggagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 548924 - DNA, 497 bp, Homo sapiens
  misc_feature: HIJSMM301DIW4R.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgatttattactgtgtagcatgggatgacagcctgagtgcttatgtcttcggaactgggaccaaggtcaccgtcctacgtcagcccaaggccaaccccact

SEQ ID NO: 548925 - DNA, 495 bp, Homo sapiens; identical to SEQ ID NO: 536827
  misc_feature: HIJSMM301D38JI.48.63.F08.1.454.light.4.raw

SEQ ID NO: 548926 - DNA, 494 bp, Homo sapiens; identical to SEQ ID NO: 534994
  misc_feature: HIJSMM301ENCLJ.27.78.H01.1.454.light.4.raw

SEQ ID NO: 548927 - DNA, 446 bp, Homo sapiens; identical to SEQ ID NO: 538346
  misc_feature: HIJSMM301BPCHT.18.9.A09.1.454.light.4.raw

SEQ ID NO: 548928 - DNA, 484 bp, Homo sapiens
  misc_feature: HIJSMM301EI98Z.47.62.F07.1.454.light.4.raw
agctcacgtacacgaccggtgctcgatttagtagtcgcataaagggaaagggggaatcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctggggacagattttactttcaccatcagcagcctgcagcctgaagatattgcaacatattactgtcaacagtatcataatctccccactttcggccctgggaccaaagtggatatcaaacgaactgtggctgcaccatct

SEQ ID NO: 548929 - DNA, 502 bp, Homo sapiens; identical to SEQ ID NO: 541971
  misc_feature: HIJSMM301DR6SW.4.39.D06.1.454.light.4.raw

SEQ ID NO: 548930 - DNA, 484 bp, Homo sapiens; identical to SEQ ID NO: 535400
  misc_feature: HIJSMM301A9G9W.46.26.C04.1.454.light.4.raw

SEQ ID NO: 548931 - DNA, 492 bp, Homo sapiens; identical to SEQ ID NO: 537666
  misc_feature: HIJSMM301ETMWL.43.33.C11.1.454.light.4.raw

SEQ ID NO: 548932 - DNA, 503 bp, Homo sapiens; identical to SEQ ID NO: 546075
  misc_feature: HIJSMM301D8GID.7.71.G05.1.454.light.4.raw

SEQ ID NO: 548933 - DNA, 511 bp, Homo sapiens; identical to SEQ ID NO: 548439
  misc_feature: HIJSMM301C7RRP.16.46.E02.1.454.light.4.raw

SEQ ID NO: 548934 - DNA, 467 bp, Homo sapiens; identical to SEQ ID NO: 541349
  misc_feature: HIJSMM301EBKFS.4.75.G09.1.454.light.4.raw

SEQ ID NO: 548935 - DNA, 486 bp, Homo sapiens
  misc_feature: HIJSMM301CFG6R.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggtttattactgcatgcaagttctacaaacttcctacacttttggccaggggaccaagctggagatcaaacgaa

SEQ ID NO: 548936 - DNA, 486 bp, Homo sapiens
  misc_feature: HIJSMM301CK5G7.5.55.E11.1.454.light.4.raw
atcagacacgcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaatcaaacgaa

SEQ ID NO: 548937 - DNA, 484 bp, Homo sapiens
  misc_feature: HIJSMM301CVDUK.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacccctggacagccggcctccatctcctgcaagtctagtcagagcctcctgcatagtgatggaaagacctatttgtattggtacctgcagaagccaggccagcctccacaggtcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtacacttttggccaggggaccaagctggagatcaaacgaa

SEQ ID NO: 548938 - DNA, 497 bp, Homo sapiens; identical to SEQ ID NO: 535664
  misc_feature: HIJSMM301AMYQX.22.14.B03.1.454.light.4.raw

SEQ ID NO: 548939 - DNA, 513 bp, Homo sapiens
  misc_feature: HIJSMM301CKUUQ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccacggaccgaacggtaggaaagtacaagcgaactagtggcgtgcgaccatcctgttcttctactcttcccgt

SEQ ID NO: 548940 - DNA, 501 bp, Homo sapiens; identical to SEQ ID NO: 535746
  misc_feature: HIJSMM301AUPU4.18.11.A11.1.454.light.4.raw

SEQ ID NO: 548941 - DNA, 505 bp, Homo sapiens; identical to SEQ ID NO: 546460
  misc_feature: HIJSMM301DGYZB.15.5.A05.1.454.light.4.raw

SEQ ID NO: 548942 - DNA, 506 bp, Homo sapiens; identical to SEQ ID NO: 539926
  misc_feature: HIJSMM301DESDW.5.24.C02.1.454.light.4.raw

SEQ ID NO: 548943 - DNA, 489 bp, Homo sapiens; identical to SEQ ID NO: 535139
  misc_feature: HIJSMM301CS3LA.14.55.E11.1.454.light.4.raw

SEQ ID NO: 548944 - DNA, 489 bp, Homo sapiens
  misc_feature: HIJSMM301CNK2C.48.27.C05.1.454.light.4.raw
agtatacatacacgaccggtgctcgatttagacgcgatcgaagggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggggcctgaagattttgcagtgtattactgtcagcagtatggtagctcacctcaactcactttcggcggagggaccaaggtggagatcaaacgaactgtggctgcacc

SEQ ID NO: 548945 - DNA, 447 bp, Homo sapiens; identical to SEQ ID NO: 535201
  misc_feature: HIJSMM301C3201.18.9.A09.1.454.light.4.raw

SEQ ID NO: 548946 - DNA, 489 bp, Homo sapiens
  misc_feature: HIJSMM301CA1WB.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggtagggaccaaggttgagatcaaacgaactgtggctgcaccatctgtcttcatt

SEQ ID NO: 548947 - DNA, 509 bp, Homo sapiens
  misc_feature: HIJSMM301AJSO0.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctc

SEQ ID NO: 548948 - DNA, 481 bp, Homo sapiens; identical to SEQ ID NO: 535993
  misc_feature: HIJSMM301CYSFO.21.25.C03.1.454.light.4.raw

SEQ ID NO: 548949 - DNA, 522 bp, Homo sapiens
  misc_feature: HIJSMM301C26FC.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtgggcaggtcacggcccaaggcccaacccactgccactcttccg

SEQ ID NO: 548950 - DNA, 465 bp, Homo sapiens; identical to SEQ ID NO: 541152
  misc_feature: HIJSMM301BUFHJ.43.71.G05.1.454.light.4.raw

SEQ ID NO: 548951 - DNA, 497 bp, Homo sapiens; identical to SEQ ID NO: 535664
  misc_feature: HIJSMM301B0HCU.22.14.B03.1.454.light.4.raw

SEQ ID NO: 548952 - DNA, 500 bp, Homo sapiens; identical to SEQ ID NO: 535310
  misc_feature: HIJSMM301BH3WP.47.66.F11.1.454.light.4.raw

SEQ ID NO: 548953 - DNA, 491 bp, Homo sapiens; identical to SEQ ID NO: 535294
  misc_feature: HIJSMM301EL6CI.16.68.G02.1.454.light.4.raw

SEQ ID NO: 548954 - DNA, 507 bp, Homo sapiens; identical to SEQ ID NO: 535641
  misc_feature: HIJSMM301AZ026.10.88.H11.1.454.light.4.raw

SEQ ID NO: 548955 - DNA, 491 bp, Homo sapiens
  misc_feature: HIJSMM301DGTZK.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatcccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatacaaacgaactgtggctgcaccatctgtt

SEQ ID NO: 548956 - DNA, 454 bp, Homo sapiens; identical to SEQ ID NO: 534964
  misc_feature: HIJSMM301AS7C1.19.86.H09.1.454.light.4.raw

SEQ ID NO: 548957 - DNA, 480 bp, Homo sapiens
  misc_feature: HIJSMM301C70M1.48.34.D01.1.454.light.4.raw
agtatacatacacgaccggtgctcgatttagatcgtctgtgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 548958 - DNA, 495 bp, Homo sapiens; identical to SEQ ID NO: 535007
  misc_feature: HIJSMM301ELHCE.22.5.A05.1.454.light.4.raw

SEQ ID NO: 548959 - DNA, 483 bp, Homo sapiens
  misc_feature: HIJSMM301BVK9K.48.40.D07.1.454.light.4.raw
agtatacatacacgaccggtgctcgatttagtgatagagcgtaacaacagagggggatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatacagcagaagtggagggctgaggatgttggagtttactaactgcatgcaagctcttgcataactgctcggacgtcgtcgacggacgaacgaggaggaga

SEQ ID NO: 548960 - DNA, 484 bp, Homo sapiens
  misc_feature: HIJSMM301B8YZY.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 548961 - DNA, 478 bp, Homo sapiens; identical to SEQ ID NO: 535129
  misc_feature: HIJSMM301DXFNP.11.11.A11.1.454.light.4.raw

SEQ ID NO: 548962 - DNA, 485 bp, Homo sapiens; identical to SEQ ID NO: 535501
  misc_feature: HIJSMM301BSI5E.3.10.A10.1.454.light.4.raw

SEQ ID NO: 548963 - DNA, 487 bp, Homo sapiens
  misc_feature: HIJSMM301DS0KP.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttatactgccaacaatatgatatttattctccagcgttcggccaggggaccaaggtggaagtcaagcgaactgtggctgcaccatctgt

SEQ ID NO: 548964 - DNA, 443 bp, Homo sapiens; identical to SEQ ID NO: 543277
  misc_feature: HIJSMM301EMZZM.18.9.A09.1.454.light.4.raw

SEQ ID NO: 548965 - DNA, 486 bp, Homo sapiens; identical to SEQ ID NO: 538568
  misc_feature: HIJSMM301AN2Z3.47.38.D05.1.454.light.4.raw

SEQ ID NO: 548966 - DNA, 491 bp, Homo sapiens
  misc_feature: HIJSMM301AQ4E3.40.37.D04.1.454.light.4.raw
tctagcgactcacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccgaaggtggagatcagacgaactgtgg

SEQ ID NO: 548967 - DNA, 508 bp, Homo sapiens; identical to SEQ ID NO: 536388
  misc_feature: HIJSMM301BATL0.11.57.F02.1.454.light.4.raw

SEQ ID NO: 548968 - DNA, 490 bp, Homo sapiens; identical to SEQ ID NO: 535936
  misc_feature: HIJSMM301D7LOB.16.68.G02.1.454.light.4.raw

SEQ ID NO: 548969 - DNA, 504 bp, Homo sapiens
  misc_feature: HIJSMM301C2K4Q.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 548970 - DNA, 496 bp, Homo sapiens; identical to SEQ ID NO: 548177
  misc_feature: HIJSMM301CX5WM.18.59.F04.1.454.light.4.raw

SEQ ID NO: 548971 - DNA, 516 bp, Homo sapiens
  misc_feature: HIJSMM301AG39C.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactatgttcccaccctcctct

SEQ ID NO: 548972 - DNA, 441 bp, Homo sapiens; identical to SEQ ID NO: 535074
  misc_feature: HIJSMM301D3RW1.11.3.A03.1.454.light.4.raw

SEQ ID NO: 548973 - DNA, 495 bp, Homo sapiens
  misc_feature: HIJSMM301BCFMA.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtgctgcacc

SEQ ID NO: 548974 - DNA, 485 bp, Homo sapiens
  misc_feature: HIJSMM301BS58W.48.77.G11.1.454.light.4.raw
agtatacatacacgaccggtgctcgatttagctagtcactcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaa

SEQ ID NO: 548975 - DNA, 502 bp, Homo sapiens
  misc_feature: HIJSMM301B85MO.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagacaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 548976 - DNA, 484 bp, Homo sapiens; identical to SEQ ID NO: 538157
  misc_feature: HIJSMM301DN2XL.26.70.G04.1.454.light.4.raw

SEQ ID NO: 548977 - DNA, 503 bp, Homo sapiens
  misc_feature: HIJSMM301DF2TJ.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggaggaccaaggtggccgtcctaggtcagcccaaggctgccccctggtcactc

SEQ ID NO: 548978 - DNA, 473 bp, Homo sapiens; identical to SEQ ID NO: 546716
  misc_feature: HIJSMM301DYJIK.52.49.E05.1.454.light.4.raw

SEQ ID NO: 548979 - DNA, 490 bp, Homo sapiens; identical to SEQ ID NO: 541974
  misc_feature: HIJSMM301DY1V0.22.65.F10.1.454.light.4.raw

SEQ ID NO: 548980 - DNA, 498 bp, Homo sapiens; identical to SEQ ID NO: 537020
  misc_feature: HIJSMM301CYAC8.26.26.C04.1.454.light.4.raw

SEQ ID NO: 548981 - DNA, 478 bp, Homo sapiens; identical to SEQ ID NO: 541928
  misc_feature: HIJSMM301COGQ5.7.76.G10.1.454.light.4.raw

SEQ ID NO: 548982 - DNA, 491 bp, Homo sapiens; identical to SEQ ID NO: 535176
  misc_feature: HIJSMM301CCYMS.13.39.D06.1.454.light.4.raw

SEQ ID NO: 548983 - DNA, 472 bp, Homo sapiens
  misc_feature: HIJSMM301CBBYT.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgattttgctcctccgagtgccacgttttggcgggggaccgaaggtggacatcaaacgaa

SEQ ID NO: 548984 - DNA, 513 bp, Homo sapiens
  misc_feature: HIJSMM301C4RON.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggcctgccccctcggtcactctgtt

SEQ ID NO: 548985 - DNA, 471 bp, Homo sapiens
  misc_feature: HIJSMM301BEBTE.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcgagggaccaaggtggagatcaaacgaactgtgg

SEQ ID NO: 548986 - DNA, 517 bp, Homo sapiens
  misc_feature: HIJSMM301D1FTH.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaaccggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggcctgccccctcggtcactctgttcccgccctcctcg

SEQ ID NO: 548987 - DNA, 507 bp, Homo sapiens
  misc_feature: HIJSMM301B6YCZ.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactcgccgacgtcgtccggggacgaccgtggaatacaaacgaactagtggctgcaccaatctgtctt

SEQ ID NO: 548988 - DNA, 490 bp, Homo sapiens
  misc_feature: HIJSMM301CI7DF.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaacgggacacgactggagattaaacgaactgtggctgcaccatctgtcttcat

SEQ ID NO: 548989 - DNA, 521 bp, Homo sapiens; identical to SEQ ID NO: 538715
  misc_feature: HIJSMM301AN7XY.27.23.C01.1.454.light.4.raw

SEQ ID NO: 548990 - DNA, 484 bp, Homo sapiens
  misc_feature: HIJSMM301AO04H.47.60.F05.1.454.light.4.raw
agctcacgtacacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacccat

SEQ ID NO: 548991 - DNA, 522 bp, Homo sapiens
  misc_feature: HIJSMM301B0Z4W.49.26.C04.1.454.light.4.raw
agtcgagagacacgaccggtgctcgatttagtctagcgactttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatagttcggcggagggaccaagctgaccgtcctaggtcagcccaaggctcgccccctcggtcactctcgttcccgccct

SEQ ID NO: 548992 - DNA, 482 bp, Homo sapiens
  misc_feature: HIJSMM301AN3G0.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcctaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggccaggggaccaggctggagatcaaacgaactgtggctgcaccat

SEQ ID NO: 548993 - DNA, 481 bp, Homo sapiens; identical to SEQ ID NO: 545581
  misc_feature: HIJSMM301DZW8H.48.19.B08.1.454.light.4.raw

SEQ ID NO: 548994 - DNA, 484 bp, Homo sapiens
  misc_feature: HIJSMM301DSSTR.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtgagatcagacgaactgtggctgcaccatctgtcttcta

SEQ ID NO: 548995 - DNA, 452 bp, Homo sapiens
  misc_feature: HIJSMM301BPIAG.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 548996 - DNA, 494 bp, Homo sapiens; identical to SEQ ID NO: 534992
  misc_feature: HIJSMM301B8QZ9.9.1.A01.1.454.light.4.raw

SEQ ID NO: 548997 - DNA, 447 bp, Homo sapiens; identical to SEQ ID NO: 535201
  misc_feature: HIJSMM301A1DG6.18.9.A09.1.454.light.4.raw

SEQ ID NO: 548998 - DNA, 482 bp, Homo sapiens
  misc_feature: HIJSMM301AUUHL.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcagtttattactgtcagcagcgtagcaactggcctctcaccttcggcggagggaccaaggtggagatcaaacgaactgtggctgca

SEQ ID NO: 548999 - DNA, 447 bp, Homo sapiens; identical to SEQ ID NO: 535020
  misc_feature: HIJSMM301D6WFI.18.9.A09.1.454.light.4.raw

SEQ ID NO: 549000 - DNA, 500 bp, Homo sapiens; identical to SEQ ID NO: 548633
  misc_feature: HIJSMM301AN61D.17.27.C05.1.454.light.4.raw

SEQ ID NO: 549001 - DNA, 494 bp, Homo sapiens; identical to SEQ ID NO: 535828
  misc_feature: HIJSMM301BURZN.3.36.D03.1.454.light.4.raw

SEQ ID NO: 549002 - DNA, 485 bp, Homo sapiens
  misc_feature: HIJSMM301C05C9.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcgggcggagggaccaagttgaccgtcctaggtcagcccaaggctcg

SEQ ID NO: 549003 - DNA, 520 bp, Homo sapiens
  misc_feature: HIJSMM301A4BRK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaagggaccgaacggtaggaaggtacgaaacgaaacgtagtggcgtgtcaccactctgtcttctactcttcccgtccact

SEQ ID NO: 549004 - DNA, 497 bp, Homo sapiens
  misc_feature: HIJSMM301AXP7Y.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggaggatcaaacgaaactgtggctgcaccatctgtctt

SEQ ID NO: 549005 - DNA, 503 bp, Homo sapiens
  misc_feature: HIJSMM301AX37R.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggt

SEQ ID NO: 549006 - DNA, 444 bp, Homo sapiens; identical to SEQ ID NO: 535192
  misc_feature: HIJSMM301AWMYW.5.9.A09.1.454.light.4.raw

SEQ ID NO: 549007 - DNA, 514 bp, Homo sapiens
  misc_feature: HIJSMM301B3MAF.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgccctcctc

SEQ ID NO: 549008 - DNA, 486 bp, Homo sapiens
  misc_feature: HIJSMM301BDMSC.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttatactgcatgcaagctctacaaactcctctcactttcggcggagggaccaaggtggagatcaaacgaactgt

SEQ ID NO: 549009 - DNA, 486 bp, Homo sapiens; identical to SEQ ID NO: 535043
  misc_feature: HIJSMM301AG9YL.46.35.D02.1.454.light.4.raw

SEQ ID NO: 549010 - DNA, 495 bp, Homo sapiens
  misc_feature: HIJSMM301CFD4B.41.33.C11.1.454.light.4.raw
tctatactatcacgaccggtgctcgatttagagtgagctcgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggaggaccaagctgaccgtcctaggtcagcccaa

SEQ ID NO: 549011 - DNA, 503 bp, Homo sapiens; identical to SEQ ID NO: 547911
  misc_feature: HIJSMM301CYYX6.7.31.C09.1.454.light.4.raw

SEQ ID NO: 549012 - DNA, 490 bp, Homo sapiens; identical to SEQ ID NO: 538273
  misc_feature: HIJSMM301BD2Z8.16.73.G07.1.454.light.4.raw

SEQ ID NO: 549013 - DNA, 495 bp, Homo sapiens
  misc_feature: HIJSMM301A9RHJ.52.2.A02.1.454.light.4.raw
cgcagtacgacacgaccggtgctcgatttagactcatctacaggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggccaacccactgtcactctgttcccaccctcctctatacgatcg

SEQ ID NO: 549014 - DNA, 494 bp, Homo sapiens
  misc_feature: HIJSMM301BZH3R.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagtctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatcaaacgaactgtggctgcaccatctgtcttc

SEQ ID NO: 549015 - DNA, 497 bp, Homo sapiens
  misc_feature: HIJSMM301CNADG.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctggctccaggctgaagacgaggctgattattactgcagctcatatacaggcagcagcactcaggttttcggcggagggaccaagctgaccgtcctaggtcagcccaaggctgccccctcggt

SEQ ID NO: 549016 - DNA, 500 bp, Homo sapiens; identical to SEQ ID NO: 548609
  misc_feature: HIJSMM301C9LH0.17.27.C05.1.454.light.4.raw

SEQ ID NO: 549017 - DNA, 503 bp, Homo sapiens
  misc_feature: HIJSMM301CRMNN.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcc

SEQ ID NO: 549018 - DNA, 518 bp, Homo sapiens; identical to SEQ ID NO: 543797
  misc_feature: HIJSMM301AZNY0.19.80.H03.1.454.light.4.raw

SEQ ID NO: 549019 - DNA, 489 bp, Homo sapiens; identical to SEQ ID NO: 535139
  misc_feature: HIJSMM301CZH17.14.55.E11.1.454.light.4.raw

SEQ ID NO: 549020 - DNA, 485 bp, Homo sapiens; identical to SEQ ID NO: 536576
  misc_feature: HIJSMM301CA9O3.46.35.D02.1.454.light.4.raw

SEQ ID NO: 549021 - DNA, 516 bp, Homo sapiens
  misc_feature: HIJSMM301BTZOZ.43.81.H04.1.454.light.4.raw
tgtgagtagtcacgaccggtgctcgatttagtagtgtagattcgcggggtggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctcctcactact

SEQ ID NO: 549022 - DNA, 514 bp, Homo sapiens
  misc_feature: HIJSMM301CMJB3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaaggaccgaacggtggaagtcaaacgaactagtggcgtgcgaccactctgtcttctatcttcccgcccact

SEQ ID NO: 549023 - DNA, 443 bp, Homo sapiens
  misc_feature: HIJSMM301CBPBF.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctgccccctcggtcactctgttcccaccctcctcgacacgcgag

SEQ ID NO: 549024 - DNA, 511 bp, Homo sapiens
  misc_feature: HIJSMM301BQIS3.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 549025 - DNA, 510 bp, Homo sapiens
  misc_feature: HIJSMM301DSQX9.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttggccaagggacccgggtggaataaaacgaactagtggctgcaccatctgtcttcta

SEQ ID NO: 549026 - DNA, 491 bp, Homo sapiens
  misc_feature: HIJSMM301AIE63.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactgtggctgcaccactctgtcttcta

SEQ ID NO: 549027 - DNA, 497 bp, Homo sapiens
  misc_feature: HIJSMM301DHLP9.43.35.D02.1.454.light.4.raw
tgtgagtagtcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaactagtggctgcaccatctgtcttcatt

SEQ ID NO: 549028 - DNA, 486 bp, Homo sapiens; identical to SEQ ID NO: 536323
  misc_feature: HIJSMM301C63HO.10.2.A02.1.454.light.4.raw

SEQ ID NO: 549029 - DNA, 494 bp, Homo sapiens; identical to SEQ ID NO: 534994
  misc_feature: HIJSMM301C6PDA.27.78.H01.1.454.light.4.raw

SEQ ID NO: 549030 - DNA, 490 bp, Homo sapiens; identical to SEQ ID NO: 535234
  misc_feature: HIJSMM301ENP1X.17.21.B10.1.454.light.4.raw

SEQ ID NO: 549031 - DNA, 491 bp, Homo sapiens; identical to SEQ ID NO: 537594
  misc_feature: HIJSMM301AS9DR.4.24.C02.1.454.light.4.raw

SEQ ID NO: 549032 - DNA, 492 bp, Homo sapiens; identical to SEQ ID NO: 541313
  misc_feature: HIJSMM301CZX0G.9.1.A01.1.454.light.4.raw

SEQ ID NO: 549033 - DNA, 506 bp, Homo sapiens; identical to SEQ ID NO: 534969
  misc_feature: HIJSMM301BZXJE.18.37.D04.1.454.light.4.raw

SEQ ID NO: 549034 - DNA, 488 bp, Homo sapiens; identical to SEQ ID NO: 535568
  misc_feature: HIJSMM301BTXD6.21.4.A04.1.454.light.4.raw

SEQ ID NO: 549035 - DNA, 508 bp, Homo sapiens; identical to SEQ ID NO: 540739
  misc_feature: HIJSMM301BIAB0.14.7.A07.1.454.light.4.raw

SEQ ID NO: 549036 - DNA, 463 bp, Homo sapiens; identical to SEQ ID NO: 535008
  misc_feature: HIJSMM301A2Q96.10.9.A09.1.454.light.4.raw

SEQ ID NO: 549037 - DNA, 495 bp, Homo sapiens
  misc_feature: HIJSMM301BRUET.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctta

SEQ ID NO: 549038 - DNA, 493 bp, Homo sapiens
  misc_feature: HIJSMM301BIQ2R.51.25.C03.1.454.light.4.raw
cgatcgtatacacgaccggtgctcgatttagtagtgtagatttgggtttggggtgggggcacttctccctctaacactctccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatcacccctctcactttcggcggagggaccaaggtggagatcaaacgaactgtggctgcaccatctgtcttcatcttcccgccat

SEQ ID NO: 549039 - DNA, 509 bp, Homo sapiens; identical to SEQ ID NO: 543772
  misc_feature: HIJSMM301B8GNE.2.21.B10.1.454.light.4.raw

SEQ ID NO: 549040 - DNA, 494 bp, Homo sapiens; identical to SEQ ID NO: 534994
  misc_feature: HIJSMM301BMEZT.27.78.H01.1.454.light.4.raw

SEQ ID NO: 549041 - DNA, 520 bp, Homo sapiens; identical to SEQ ID NO: 535773
  misc_feature: HIJSMM301AXYWB.41.19.B08.1.454.light.4.raw

SEQ ID NO: 549042 - DNA, 503 bp, Homo sapiens
  misc_feature: HIJSMM301CSYLR.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgacttttcggcggagggaccaagctgaccgtcctgggtcagcccaaggctgccccctcggtcta

SEQ ID NO: 549043 - DNA, 498 bp, Homo sapiens
  misc_feature: HIJSMM301CRL5B.48.72.G06.1.454.light.4.raw
agtatacatacacgaccggtgctcgatttagctacgactgcaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 549044 - DNA, 445 bp, Homo sapiens; identical to SEQ ID NO: 537152
  misc_feature: HIJSMM301AP2NE.5.9.A09.1.454.light.4.raw

SEQ ID NO: 549045 - DNA, 490 bp, Homo sapiens
  misc_feature: HIJSMM301AUW9C.12.67.G01.1.454.light.4.raw
atacgacgtacacgaccggtgctcgatttagagtatacatattgggtttggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccaccctcctctacgtcgtat

SEQ ID NO: 549046 - DNA, 486 bp, Homo sapiens
  misc_feature: HIJSMM301C3U3Y.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggtcggagggaccgaagctgaccgtcctaggtcagacccg

SEQ ID NO: 549047 - DNA, 493 bp, Homo sapiens; identical to SEQ ID NO: 539702
  misc_feature: HIJSMM301ERIIM.27.78.H01.1.454.light.4.raw

SEQ ID NO: 549048 - DNA, 493 bp, Homo sapiens
  misc_feature: HIJSMM301B9GX0.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaagg

SEQ ID NO: 549049 - DNA, 478 bp, Homo sapiens; identical to SEQ ID NO: 535129
  misc_feature: HIJSMM301AZNWT.11.11.A11.1.454.light.4.raw

SEQ ID NO: 549050 - DNA, 507 bp, Homo sapiens
  misc_feature: HIJSMM301BJ7PN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactagtggctgcaccatctgtt

SEQ ID NO: 549051 - DNA, 516 bp, Homo sapiens
  misc_feature: HIJSMM301EM7US.53.6.A06.1.454.light.4.raw
cgcgtatacacacgaccggtgctcgatttagatctactgacaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaagtcggccagatttacctgtgagggaaggcacattgaaactaaaagtgtgcactggtaccagaagaagccaggccaggcccctgtggtggtcgtctatgatgatagcgaccggccctcagggatccctgagcgattctctggctccagctctgggaacacggccaccctgaccatccacagggtcgaatccggggatgaggccgactatttttgtcaggtgtgggatagccttagtgaccaaccggtgttcggcggagggaccaagctggccgtcctaggtcagcccaaggctgccccctcggtcactctgttcccgccctcctctcgta

SEQ ID NO: 549052 - DNA, 451 bp, Homo sapiens
  misc_feature: HIJSMM301BAMCB.18.5.A05.1.454.light.4.raw
tacgagtatgcacgaccggtgctcgatttagatagatagacagggtggaaggagactgggacatccagatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgcatctgacatactcgta

SEQ ID NO: 549053 - DNA, 504 bp, Homo sapiens
  misc_feature: HIJSMM301C6UN3.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 549054 - DNA, 441 bp, Homo sapiens
  misc_feature: HIJSMM301BXXZY.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgactgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 549055 - DNA, 489 bp, Homo sapiens; identical to SEQ ID NO: 536663
  misc_feature: HIJSMM301ALQ7C.16.72.G06.1.454.light.4.raw

SEQ ID NO: 549056 - DNA, 494 bp, Homo sapiens; identical to SEQ ID NO: 534994
  misc_feature: HIJSMM301ANIQD.27.78.H01.1.454.light.4.raw

SEQ ID NO: 549057 - DNA, 494 bp, Homo sapiens
  misc_feature: HIJSMM301C5TR9.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcatt

SEQ ID NO: 549058 - DNA, 486 bp, Homo sapiens; identical to SEQ ID NO: 537310
  misc_feature: HIJSMM301ERX06.15.28.C06.1.454.light.4.raw

SEQ ID NO: 549059 - DNA, 506 bp, Homo sapiens; identical to SEQ ID NO: 537290
  misc_feature: HIJSMM301BRRGE.13.11.A11.1.454.light.4.raw

SEQ ID NO: 549060 - DNA, 477 bp, Homo sapiens
  misc_feature: HIJSMM301A0HMU.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctccactttcggcgggggaccgaaggtggaggatcaagcgaactgtggctgca

SEQ ID NO: 549061 - DNA, 488 bp, Homo sapiens; identical to SEQ ID NO: 535861
  misc_feature: HIJSMM301BOMGA.14.55.E11.1.454.light.4.raw

SEQ ID NO: 549062 - DNA, 512 bp, Homo sapiens
  misc_feature: HIJSMM301DIDU6.10.75.G09.1.454.light.4.raw
catagtagtgcacgaccggtgctcgatttagtatagacatcaggggggggtcgtcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctgccccctcggtcactctcgttccca

SEQ ID NO: 549063 - DNA, 501 bp, Homo sapiens
  misc_feature: HIJSMM301DYXAT.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagataaacg

SEQ ID NO: 549064 - DNA, 493 bp, Homo sapiens
  misc_feature: HIJSMM301CBMMK.27.78.H01.1.454.light.4.raw
  modified_base (464)..(464): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtggctgcaccatctgt

SEQ ID NO: 549065 - DNA, 493 bp, Homo sapiens
  misc_feature: HIJSMM301CLYE4.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccaagctggagatcaaacgaactgtggctgcaccatct

SEQ ID NO: 549066 - DNA, 466 bp, Homo sapiens; identical to SEQ ID NO: 536398
  misc_feature: HIJSMM301C4UI2.3.20.B09.1.454.light.4.raw

SEQ ID NO: 549067 - DNA, 500 bp, Homo sapiens
  misc_feature: HIJSMM301ESUD6.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagttttattactgtcagcagcgtatcgactggatcaccttcggccaagggacacgactggaaattaaacgaactgtggctgcaccatctgtcttcatcttccccg

SEQ ID NO: 549068 - DNA, 499 bp, Homo sapiens; identical to SEQ ID NO: 537739
  misc_feature: HIJSMM301BLSIG.12.86.H09.1.454.light.4.raw

SEQ ID NO: 549069 - DNA, 513 bp, Homo sapiens; identical to SEQ ID NO: 535244
  misc_feature: HIJSMM301ARE0I.17.33.C11.1.454.light.4.raw

SEQ ID NO: 549070 - DNA, 447 bp, Homo sapiens; identical to SEQ ID NO: 535882
  misc_feature: HIJSMM301AR2OP.18.9.A09.1.454.light.4.raw
  modified_base (429)..(429): a, c, t, g, unknown or other

SEQ ID NO: 549071 - DNA, 447 bp, Homo sapiens
  misc_feature: HIJSMM301APFSV.18.9.A09.1.454.light.4.raw
tacgagtatgcacgaccggtgctcgatttagcgagacgcgcagggtcctgggcccagtctgtgctgacgcagccgccctcagtgtctgggtccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 549072 - DNA, 496 bp, Homo sapiens
  misc_feature: HIJSMM301DGGSB.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgactgtggctgcacca

SEQ ID NO: 549073 - DNA, 444 bp, Homo sapiens; identical to SEQ ID NO: 536096
  misc_feature: HIJSMM301AOS7X.7.18.B07.1.454.light.4.raw

SEQ ID NO: 549074 - DNA, 500 bp, Homo sapiens; identical to SEQ ID NO: 539563
  misc_feature: HIJSMM301AOS70.8.2.A02.1.454.light.4.raw

SEQ ID NO: 549075 - DNA, 498 bp, Homo sapiens
  misc_feature: HIJSMM301BVXKY.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactacttttggccaggggaccaagctggagatcaaacgaactgtggctgcacatctgt

SEQ ID NO: 549076 - DNA, 509 bp, Homo sapiens; identical to SEQ ID NO: 543772
  misc_feature: HIJSMM301APZRR.2.21.B10.1.454.light.4.raw

SEQ ID NO: 549077 - DNA, 505 bp, Homo sapiens; identical to SEQ ID NO: 538054
  misc_feature: HIJSMM301A8JRX.8.55.E11.1.454.light.4.raw

SEQ ID NO: 549078 - DNA, 471 bp, Homo sapiens
  misc_feature: HIJSMM301CF7JP.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacttcggccaagggaccaaggtggaaatcaaacgaa

SEQ ID NO: 549079 - DNA, 499 bp, Homo sapiens
  misc_feature: HIJSMM301DAAOG.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtca

SEQ ID NO: 549080 - DNA, 503 bp, Homo sapiens
  misc_feature: HIJSMM301DV3RK.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcact

SEQ ID NO: 549081 - DNA, 490 bp, Homo sapiens; identical to SEQ ID NO: 534991
  misc_feature: HIJSMM301AYFP6.48.75.G09.1.454.light.4.raw

SEQ ID NO: 549082 - DNA, 510 bp, Homo sapiens; identical to SEQ ID NO: 535855
  misc_feature: HIJSMM301AFK7K.17.33.C11.1.454.light.4.raw

SEQ ID NO: 549083 - DNA, 473 bp, Homo sapiens; identical to SEQ ID NO: 535262
  misc_feature: HIJSMM301DE1M3.8.67.G01.1.454.light.4.raw

SEQ ID NO: 549084 - DNA, 500 bp, Homo sapiens; identical to SEQ ID NO: 546350
  misc_feature: HIJSMM301CYFEY.51.19.B08.1.454.light.4.raw

SEQ ID NO: 549085 - DNA, 506 bp, Homo sapiens
  misc_feature: HIJSMM301EP5W9.17.86.H09.1.454.light.4.raw
cgtagactagcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgacctcagcctgcctccgtgtctgggtctcctggacagtcgatcaccatctcctgcactggaagcggcagtgatgttgggggttataaccttgtctcctggtaccaacaccacccagacaaagcccccaaactcatcctttatgagggacactaagcggccctcaggggtttctaatcgcttcgctggctccacgtctggcagcacggcctccctgacaatctctgggctccaggctgaggacgaggctgattattactgctgctcatattcaagtcgtgtcactatgattttggcggaggcaccaaggtgaccgtcctaggtcagcccaaggctgccccctcggt

SEQ ID NO: 549086 - DNA, 505 bp, Homo sapiens
  misc_feature: HIJSMM301A95IZ.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactagtggctgcaccatctgtcttcatt

SEQ ID NO: 549087 - DNA, 500 bp, Homo sapiens; identical to SEQ ID NO: 535310
  misc_feature: HIJSMM301B3TWD.47.66.F11.1.454.light.4.raw

SEQ ID NO: 549088 - DNA, 512 bp, Homo sapiens
  misc_feature: HIJSMM301C72KU.17.33.C11.1.454.light.4.raw
  modified_base (463)..(463): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtnttaagtcagcccaaggctgccccctcggtcactctgttcccaccctcct

SEQ ID NO: 549089 - DNA, 507 bp, Homo sapiens
  misc_feature: HIJSMM301DJ0N1.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctgccccccg

SEQ ID NO: 549090 - DNA, 512 bp, Homo sapiens; identical to SEQ ID NO: 541300
  misc_feature: HIJSMM301ENPBJ.17.33.C11.1.454.light.4.raw

SEQ ID NO: 549091 - DNA, 513 bp, Homo sapiens
  misc_feature: HIJSMM301C0ETO.15.86.H09.1.454.light.4.raw
tctacgtagccacgaccggtgctcgatttagtgctatagacttgggtttggggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtggttcggcggagggaccaagctgaccgtcctaggtcagcccaaggctgcccccctcggtcactctgttccccaccctcctcgctacgt

SEQ ID NO: 549092 - DNA, 516 bp, Homo sapiens
  misc_feature: HIJSMM301C787D.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcctg

SEQ ID NO: 549093 - DNA, 496 bp, Homo sapiens
  misc_feature: HIJSMM301DIKEX.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccc

SEQ ID NO: 549094 - DNA, 501 bp, Homo sapiens
  misc_feature: HIJSMM301BUI9O.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaatcaaacgaactgtggctgcaccatctgtcttcta

SEQ ID NO: 549095 - DNA, 447 bp, Homo sapiens; identical to SEQ ID NO: 535020
  misc_feature: HIJSMM301CZ2P7.18.9.A09.1.454.light.4.raw

SEQ ID NO: 549096 - DNA, 503 bp, Homo sapiens; identical to SEQ ID NO: 543938
  misc_feature: HIJSMM301C6ZTA.4.71.G05.1.454.light.4.raw

SEQ ID NO: 549097 - DNA, 490 bp, Homo sapiens
  misc_feature: HIJSMM301AGNL2.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccagggaccaaactggatatcagacgaactgtggctgca

SEQ ID NO: 549098 - DNA, 389 bp, Homo sapiens; identical to SEQ ID NO: 540091
  misc_feature: HIJSMM301DUSHK.21.40.D07.1.454.light.4.raw

SEQ ID NO: 549099 - DNA, 503 bp, Homo sapiens
  misc_feature: HIJSMM301AVM3W.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtggccactttcggcggagggaccgaaaatagaggtcaacgaactgtggctgcaccatctgtcttcat

SEQ ID NO: 549100 - DNA, 486 bp, Homo sapiens; identical to SEQ ID NO: 535043
  misc_feature: HIJSMM301AQALM.46.35.D02.1.454.light.4.raw

SEQ ID NO: 549101 - DNA, 509 bp, Homo sapiens
  misc_feature: HIJSMM301DSNR0.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataattatgacgtcaatgttcgccctcaggggtttctcatcgcttctctggctccaaatctggcaacacggcctccctgaccatctctgggctcgagtctgaggacgaggctgattactctgttgctcttgggcaactactgtcgtttgggtgttcgcggagggaccaagttgaccgtcctaggtcagcccaaggctgccccctcggtcactctgttccccg

SEQ ID NO: 549102 - DNA, 504 bp, Homo sapiens
  misc_feature: HIJSMM301CUD47.18.78.H01.1.454.light.4.raw
  modified_base (498)..(498): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccnctgtca

SEQ ID NO: 549103 - DNA, 483 bp, Homo sapiens
  misc_feature: HIJSMM301DNRZL.7.75.G09.1.454.light.4.raw
cgtgtctctacacgaccggtgctcgatttagtatagacatcagggggcaggagtcagacccacgtcaggacacagcatggacatgagggtccccgcctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccagggacacgactgagattaaacgaactgtggctgcaccatctgt

SEQ ID NO: 549104 - DNA, 484 bp, Homo sapiens; identical to SEQ ID NO: 535400
  misc_feature: HIJSMM301A1YMY.46.26.C04.1.454.light.4.raw

SEQ ID NO: 549105 - DNA, 505 bp, Homo sapiens
  misc_feature: HIJSMM301AFK6H.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatacgtcctcctctcacgttcgggcggagggaccaaggtggagatacaaacgaactgtggctgcaccatctgtctt

SEQ ID NO: 549106 - DNA, 536 bp, Homo sapiens
  misc_feature: HIJSMM301DGGS3.10.28.C06.1.454.light.4.raw
catagtagtgcacgaccggtgctcgatttagagctcacgtattgggtttgggggggtcgtcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaaaacggcctccctgaccatctctgggcgtccagactgaggacgaggcgtgattattacttgcagctcacatacaagacggcgagcggttgggttggttaacggtcgggggaccggacactgaccgtcctacggtcgagcccaacggctgccccctccggtccgactctcgttcccta

SEQ ID NO: 549107 - DNA, 444 bp, Homo sapiens; identical to SEQ ID NO: 536096
  misc_feature: HIJSMM301A95J6.7.18.B07.1.454.light.4.raw

SEQ ID NO: 549108 - DNA, 504 bp, Homo sapiens; identical to SEQ ID NO: 547223
  misc_feature: HIJSMM301BEQ35.18.37.D04.1.454.light.4.raw

SEQ ID NO: 549109 - DNA, 500 bp, Homo sapiens; identical to SEQ ID NO: 542309
  misc_feature: HIJSMM301CH6AO.12.86.H09.1.454.light.4.raw

SEQ ID NO: 549110 - DNA, 497 bp, Homo sapiens
  misc_feature: HIJSMM301AD1S5.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccccaagaacttttggtccgacgggaacgaacgactggagaatacaaacgaaactgtggcgtgcaccact

SEQ ID NO: 549111 - DNA, 478 bp, Homo sapiens
  misc_feature: HIJSMM301BQM6G.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgagtagtaca

SEQ ID NO: 549112 - DNA, 498 bp, Homo sapiens
  misc_feature: HIJSMM301C8F8N.48.37.D04.1.454.light.4.raw
agtatacatacacgaccggtgctcgatttagtagcatactggttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctcg

SEQ ID NO: 549113 - DNA, 485 bp, Homo sapiens
  misc_feature: HIJSMM301CK9GI.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaaggttgaccgtcctaggtcagcccaaggctcg

SEQ ID NO: 549114 - DNA, 453 bp, Homo sapiens; identical to SEQ ID NO: 535173
  misc_feature: HIJSMM301CDKP3.19.86.H09.1.454.light.4.raw

SEQ ID NO: 549115 - DNA, 484 bp, Homo sapiens; identical to SEQ ID NO: 535240
  misc_feature: HIJSMM301AXDZX.47.60.F05.1.454.light.4.raw

SEQ ID NO: 549116 - DNA, 515 bp, Homo sapiens
  misc_feature: HIJSMM301AN0S2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagctcaaggctgccccctcgtcactctgtcccg

SEQ ID NO: 549117 - DNA, 515 bp, Homo sapiens
  misc_feature: HIJSMM301C0XH0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaacggtaggaaagtacaaaacgaactagtggcgtgcgaccatctgtcttctatcttccccg

SEQ ID NO: 549118 - DNA, 454 bp, Homo sapiens; identical to SEQ ID NO: 535005
  misc_feature: HIJSMM301D6087.19.86.H09.1.454.light.4.raw

SEQ ID NO: 549119 - DNA, 518 bp, Homo sapiens
  misc_feature: HIJSMM301DMQSC.9.86.H09.1.454.light.4.raw
tgatacgtctcacgaccggtgctcgatttagtgctatagacttgggtttggggggggtcgacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctggtcactctgttcccgcctccta

SEQ ID NO: 549120 - DNA, 503 bp, Homo sapiens
  misc_feature: HIJSMM301BJ92K.9.12.B01.1.454.light.4.raw
  modified_base (422)..(422): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagacagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacngttttctcgggcttcggccaagggaccaaggtggaagtacaaacgaactagtggctgcaccatctgtcttcatcttccccg

SEQ ID NO: 549121 - DNA, 496 bp, Homo sapiens
  misc_feature: HIJSMM301CPW1B.12.67.G01.1.454.light.4.raw
atacgacgtacacgaccggtgctcgatttagagtatacatattgggttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaggtcacgtctacgtcagcccaaggccaaccca

SEQ ID NO: 549122 - DNA, 513 bp, Homo sapiens
  misc_feature: HIJSMM301D8CFT.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccgccctcctcgctacg

SEQ ID NO: 549123 - DNA, 491 bp, Homo sapiens
  misc_feature: HIJSMM301DNOPU.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggtccaaggaccgaaggtggaaatacaaacgaactagtggctgcaccatctgtctt

SEQ ID NO: 549124 - DNA, 497 bp, Homo sapiens; identical to SEQ ID NO: 535286
  misc_feature: HIJSMM301DGY4E.18.59.F04.1.454.light.4.raw

SEQ ID NO: 549125 - DNA, 502 bp, Homo sapiens
  misc_feature: HIJSMM301D8QBD.51.79.H02.1.454.light.4.raw
cgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatct

SEQ ID NO: 549126 - DNA, 485 bp, Homo sapiens; identical to SEQ ID NO: 539315
  misc_feature: HIJSMM301CC743.3.88.H11.1.454.light.4.raw

SEQ ID NO: 549127 - DNA, 465 bp, Homo sapiens; identical to SEQ ID NO: 542124
  misc_feature: HIJSMM301A3NBQ.48.59.F04.1.454.light.4.raw

SEQ ID NO: 549128 - DNA, 494 bp, Homo sapiens; identical to SEQ ID NO: 535944
  misc_feature: HIJSMM301AM8PP.40.80.H03.1.454.light.4.raw

SEQ ID NO: 549129 - DNA, 493 bp, Homo sapiens; identical to SEQ ID NO: 535047
  misc_feature: HIJSMM301D3XP2.16.53.E09.1.454.light.4.raw

SEQ ID NO: 549130 - DNA, 483 bp, Homo sapiens; identical to SEQ ID NO: 542200
  misc_feature: HIJSMM301DNDSZ.7.75.G09.1.454.light.4.raw

SEQ ID NO: 549131 - DNA, 494 bp, Homo sapiens; identical to SEQ ID NO: 539784
  misc_feature: HIJSMM301DEDQN.22.57.F02.1.454.light.4.raw

SEQ ID NO: 549132 - DNA, 515 bp, Homo sapiens
  misc_feature: HIJSMM301EYL6Y.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcct

SEQ ID NO: 549133 - DNA, 507 bp, Homo sapiens
  misc_feature: HIJSMM301CA9U2.40.35.D02.1.454.light.4.raw
tctagcgactcacgaccggtgctcgatttagcacacgatagttgggtttgggggaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggaggatcaagcgaactgtggctgcaccatctgtcttcatcttcccg

SEQ ID NO: 549134 - DNA, 492 bp, Homo sapiens; identical to SEQ ID NO: 541395
  misc_feature: HIJSMM301ERQ74.21.47.E03.1.454.light.4.raw

SEQ ID NO: 549135 - DNA, 483 bp, Homo sapiens
  misc_feature: HIJSMM301A9KJQ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggtctgttcggcggcgggacc

SEQ ID NO: 549136 - DNA, 475 bp, Homo sapiens
  misc_feature: HIJSMM301EXYWX.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcgagggaccaaggtgagatcaaacgaactgtggctgcaccatctgtt

SEQ ID NO: 549137 - DNA, 511 bp, Homo sapiens
  misc_feature: HIJSMM301CNJS4.43.19.B08.1.454.light.4.raw
tgtgagtagtcacgaccggtgctcgatttagtgagtcagtaaggggctggccgtaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccgggatgaggccgactattactgtcaggtgtgggataatggtggtgatcatccggtcttcggcggaggaccaagttgaccgtcctaaagtcagcccaaggctgccccctcggtcactctgttcccgccctcctca

SEQ ID NO: 549138 - DNA, 463 bp, Homo sapiens; identical to SEQ ID NO: 535062
  misc_feature: HIJSMM301EL77H.11.73.G07.1.454.light.4.raw

SEQ ID NO: 549139 - DNA, 515 bp, Homo sapiens
  misc_feature: HIJSMM301BM8Z5.51.80.H03.1.454.light.4.raw
cgatcgtatacacgaccggtgctcgatttagctgtgcgtcgaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccaagctgaccgtcctaggtcagcccaaggctgccccctcggtcactctgttcccacctcctc

SEQ ID NO: 549140 - DNA, 488 bp, Homo sapiens; identical to SEQ ID NO: 535125
  misc_feature: HIJSMM301B7JBK.17.25.C03.1.454.light.4.raw

SEQ ID NO: 549141 - DNA, 502 bp, Homo sapiens
  misc_feature: HIJSMM301BUT72.15.1.A01.1.454.light.4.raw
  modified_base (461)..(461): a, c, t, g, unknown or other
tctacgtagccacgaccggtgctcgatttagacgtctcatcagggggggtcgacaagaggcagcgctctcgggacgtctccaccatggcctgggcgtctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacatcaccccggcagagcccccaaactcatgatttatgaggccactaagcgaccctcagggctttctaatcgcttctctggctccaagtctggcaacacggcctccctgacaatctctgggctccaggctgacgacgaggactaattatactgctgctacatatgaaggttataacactatactatcggcgggaggaccaagntgaccgtcctgcgtcacgcccaaggctcgccccctcggtac

SEQ ID NO: 549142 - DNA, 496 bp, Homo sapiens; identical to SEQ ID NO: 545280
  misc_feature: HIJSMM301B52RH.18.59.F04.1.454.light.4.raw

SEQ ID NO: 549143 - DNA, 486 bp, Homo sapiens; identical to SEQ ID NO: 536323
  misc_feature: HIJSMM301AMVO1.10.2.A02.1.454.light.4.raw

SEQ ID NO: 549144 - DNA, 490 bp, Homo sapiens
  misc_feature: HIJSMM301EP01T.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactaactgtcaacagagttacagtacccccctcactttcggcggagggaccaaggcggagatcagacgaactgtggctgcaccatctgtcttcta

SEQ ID NO: 549145 - DNA, 464 bp, Homo sapiens
  misc_feature: HIJSMM301EDLB8.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgcccatctgacactactatg

SEQ ID NO: 549146 - DNA, 447 bp, Homo sapiens; identical to SEQ ID NO: 535201
  misc_feature: HIJSMM301EHRG4.18.9.A09.1.454.light.4.raw

SEQ ID NO: 549147 - DNA, 483 bp, Homo sapiens; identical to SEQ ID NO: 535413
  misc_feature: HIJSMM301DUQK8.26.78.H01.1.454.light.4.raw

SEQ ID NO: 549148 - DNA, 499 bp, Homo sapiens
  misc_feature: HIJSMM301C3PZE.40.71.G05.1.454.light.4.raw
tctagcgactcacgaccggtgctcgatttagtgtcgtcgcaagagagagggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggacaaactgaccgtcctaggtcagccc

SEQ ID NO: 549149 - DNA, 486 bp, Homo sapiens; identical to SEQ ID NO: 536323
  misc_feature: HIJSMM301BXXHW.10.2.A02.1.454.light.4.raw

SEQ ID NO: 549150 - DNA, 502 bp, Homo sapiens; identical to SEQ ID NO: 539314
  misc_feature: HIJSMM301AP27S.21.81.H04.1.454.light.4.raw

SEQ ID NO: 549151 - DNA, 496 bp, Homo sapiens; identical to SEQ ID NO: 535109
  misc_feature: HIJSMM301EQQSJ.16.78.H01.1.454.light.4.raw

SEQ ID NO: 549152 - DNA, 494 bp, Homo sapiens
  misc_feature: HIJSMM301A4XKK.22.57.F02.1.454.light.4.raw
acatacgcgtcacgaccggtgctcgatttagctcgatatagttgggtttggggagtcagacccagtcaagacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 549153 - DNA, 498 bp, Homo sapiens
  misc_feature: HIJSMM301A2TBZ.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgtttcggccaagggaccaaacggtggaaatacagacgaactacgtggctgcaccactctgtcttcta

SEQ ID NO: 549154 - DNA, 519 bp, Homo sapiens
  misc_feature: HIJSMM301BW8K7.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcct

SEQ ID NO: 549155 - DNA, 489 bp, Homo sapiens; identical to SEQ ID NO: 535386
  misc_feature: HIJSMM301CENMM.12.51.E07.1.454.light.4.raw

SEQ ID NO: 549156 - DNA, 495 bp, Homo sapiens; identical to SEQ ID NO: 535596
  misc_feature: HIJSMM301BS7LD.10.79.H02.1.454.light.4.raw

SEQ ID NO: 549157 - DNA, 508 bp, Homo sapiens
  misc_feature: HIJSMM301ELX47.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccg

SEQ ID NO: 549158 - DNA, 499 bp, Homo sapiens
  misc_feature: HIJSMM301DP1CN.2.49.E05.1.454.light.4.raw
acgctcgacacacgaccggtgctcgatttagagcgactagcaacacacaaaggggggggaaggctcagcttcagctgtggtagagaagacaggattcaggacaatctccagcatggccggcttccctctcctcctcaccctcctcactcactgtgcagggtccgtgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 549159 - DNA, 467 bp, Homo sapiens; identical to SEQ ID NO: 538403
  misc_feature: HIJSMM301A7BMF.41.48.E04.1.454.light.4.raw

SEQ ID NO: 549160 - DNA, 521 bp, Homo sapiens
  misc_feature: HIJSMM301DYMSX.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccct

SEQ ID NO: 549161 - DNA, 500 bp, Homo sapiens
  misc_feature: HIJSMM301CSCF5.48.55.E11.1.454.light.4.raw
agtatacatacacgaccggtgctcgatttagcactcgcacgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacca

SEQ ID NO: 549162 - DNA, 505 bp, Homo sapiens
  misc_feature: HIJSMM301A75LG.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaaactgtggctgcaccatct

SEQ ID NO: 549163 - DNA, 503 bp, Homo sapiens; identical to SEQ ID NO: 536834
  misc_feature: HIJSMM301ETUZJ.2.35.D02.1.454.light.4.raw

SEQ ID NO: 549164 - DNA, 485 bp, Homo sapiens; identical to SEQ ID NO: 543180
  misc_feature: HIJSMM301BAIIF.3.10.A10.1.454.light.4.raw

SEQ ID NO: 549165 - DNA, 511 bp, Homo sapiens; identical to SEQ ID NO: 545985
  misc_feature: HIJSMM301CUBL6.7.34.D01.1.454.light.4.raw

SEQ ID NO: 549166 - DNA, 486 bp, Homo sapiens; identical to SEQ ID NO: 535290
  misc_feature: HIJSMM301B7BSN.3.12.B01.1.454.light.4.raw

SEQ ID NO: 549167 - DNA, 496 bp, Homo sapiens; identical to SEQ ID NO: 536248
  misc_feature: HIJSMM301EETIF.22.27.C05.1.454.light.4.raw

SEQ ID NO: 549168 - DNA, 482 bp, Homo sapiens
  misc_feature: HIJSMM301DUEDQ.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccaatcagcagcctgcaacctgaagatattgcaacatattaactgtcaacagtatgatagtctggccgccttcggcggagggaccgaaggtaggagatcgaacgaactagtggctgca

SEQ ID NO: 549169 - DNA, 516 bp, Homo sapiens; identical to SEQ ID NO: 542547
  misc_feature: HIJSMM301DPTV3.5.27.C05.1.454.light.4.raw

SEQ ID NO: 549170 - DNA, 492 bp, Homo sapiens
  misc_feature: HIJSMM301CG6VM.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacc

SEQ ID NO: 549171 - DNA, 490 bp, Homo sapiens
  misc_feature: HIJSMM301AR9J3.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctcgccccctcggtcact

SEQ ID NO: 549172 - DNA, 498 bp, Homo sapiens
  misc_feature: HIJSMM301BAU76.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggagatcaaaacgaactgtggctgcaccatctgtt

SEQ ID NO: 549173 - DNA, 494 bp, Homo sapiens; identical to SEQ ID NO: 534994
  misc_feature: HIJSMM301D5T7S.27.78.H01.1.454.light.4.raw

SEQ ID NO: 549174 - DNA, 510 bp, Homo sapiens; identical to SEQ ID NO: 542037
  misc_feature: HIJSMM301EQ6IB.4.57.F02.1.454.light.4.raw

SEQ ID NO: 549175 - DNA, 486 bp, Homo sapiens; identical to SEQ ID NO: 535043
  misc_feature: HIJSMM301BWEW1.46.35.D02.1.454.light.4.raw

SEQ ID NO: 549176 - DNA, 490 bp, Homo sapiens
  misc_feature: HIJSMM301DA5VG.18.11.A11.1.454.light.4.raw
  modified_base (488)..(488): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtcttcatcttcccgnat

SEQ ID NO: 549177 - DNA, 473 bp, Homo sapiens
  misc_feature: HIJSMM301COMEW.5.53.E09.1.454.light.4.raw
atcagacacgcacgaccggtgctcgatttagagagagtgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgacctggagattaaacgaa

SEQ ID NO: 549178 - DNA, 484 bp, Homo sapiens; identical to SEQ ID NO: 535400
  misc_feature: HIJSMM301BL5CV.46.26.C04.1.454.light.4.raw

SEQ ID NO: 549179 - DNA, 502 bp, Homo sapiens
  misc_feature: HIJSMM301B4TB8.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccg

SEQ ID NO: 549180 - DNA, 485 bp, Homo sapiens; identical to SEQ ID NO: 535363
  misc_feature: HIJSMM301CU8TB.17.26.C04.1.454.light.4.raw

SEQ ID NO: 549181 - DNA, 466 bp, Homo sapiens
  misc_feature: HIJSMM301BRGOF.5.36.D03.1.454.light.4.raw
atcagacacgcacgaccggtgctcgatttagctgcgtcacgatctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattaactgccaacagtatgatt

SEQ ID NO: 549182 - DNA, 486 bp, Homo sapiens
  misc_feature: HIJSMM301DHWSO.4.33.C11.1.454.light.4.raw
  modified_base (458)..(458): a, c, t, g, unknown or other
agcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttgtcggnggaccgaaggtaggagagtacaacgaaa

SEQ ID NO: 549183 - DNA, 495 bp, Homo sapiens; identical to SEQ ID NO: 545183
  misc_feature: HIJSMM301B25OU.16.10.A10.1.454.light.4.raw

SEQ ID NO: 549184 - DNA, 494 bp, Homo sapiens; identical to SEQ ID NO: 536974
  misc_feature: HIJSMM301EQIFH.16.86.H09.1.454.light.4.raw

SEQ ID NO: 549185 - DNA, 494 bp, Homo sapiens; identical to SEQ ID NO: 535184
  misc_feature: HIJSMM301DWAJ5.16.71.G05.1.454.light.4.raw

SEQ ID NO: 549186 - DNA, 484 bp, Homo sapiens; identical to SEQ ID NO: 535211
  misc_feature: HIJSMM301APLXD.47.46.E02.1.454.light.4.raw

SEQ ID NO: 549187 - DNA, 505 bp, Homo sapiens
  misc_feature: HIJSMM301AK4U7.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctctacgtcgtat

SEQ ID NO: 549188 - DNA, 529 bp, Homo sapiens
  misc_feature: HIJSMM301DJ5DB.13.42.D09.1.454.light.4.raw
  modified_base (431)..(431): a, c, t, g, unknown or other
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcaggtgggtctgggacagacttcactctcaccatcagcagactggagcctgaagtattttgtcagtgatttttttttttttttttttttttacngtcagcagtatggtagctcacctcggacggttcggtccgaacggaccgaacggtaggtaagtacaaacgaacgtacgtggtcgtgcaccactctgttc

SEQ ID NO: 549189 - DNA, 447 bp, Homo sapiens; identical to SEQ ID NO: 535020
  misc_feature: HIJSMM301DH0QG.18.9.A09.1.454.light.4.raw

SEQ ID NO: 549190 - DNA, 537 bp, Homo sapiens
  misc_feature: HIJSMM301AE9T2.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggagtgaggccgactattactgtcaggtgtggaatggtgattatgattatgtcttcggtaactgggaccaaggtcaccgtcctaggtcgagcccaacggccgaacccccacctacgtcactctcgttccctacccctccctcccgttcg

SEQ ID NO: 549191 - DNA, 500 bp, Homo sapiens; identical to SEQ ID NO: 541228
  misc_feature: HIJSMM301BO7ZB.13.11.A11.1.454.light.4.raw

SEQ ID NO: 549192 - DNA, 494 bp, Homo sapiens; identical to SEQ ID NO: 535276
  misc_feature: HIJSMM301C15GS.16.6.A06.1.454.light.4.raw

SEQ ID NO: 549193 - DNA, 512 bp, Homo sapiens; identical to SEQ ID NO: 542831
  misc_feature: HIJSMM301BQS0Y.43.19.B08.1.454.light.4.raw

SEQ ID NO: 549194 - DNA, 482 bp, Homo sapiens
  misc_feature: HIJSMM301AMRDQ.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctggacgttcggccaagggaccaaggtggaaatcaaacgaactagtggctgcaccatctgtcttcta

SEQ ID NO: 549195 - DNA, 447 bp, Homo sapiens; identical to SEQ ID NO: 535201
  misc_feature: HIJSMM301B5YRR.18.9.A09.1.454.light.4.raw

SEQ ID NO: 549196 - DNA, 487 bp, Homo sapiens
  misc_feature: HIJSMM301D5QGT.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggtctttctaatcgcttctctgactccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctgttcccgccctcctcgctacgtaga

SEQ ID NO: 549197 - DNA, 504 bp, Homo sapiens; identical to SEQ ID NO: 547223
  misc_feature: HIJSMM301EWJCY.18.37.D04.1.454.light.4.raw

SEQ ID NO: 549198 - DNA, 492 bp, Homo sapiens
  misc_feature: HIJSMM301BS71Q.22.25.C03.1.454.light.4.raw
acatacgcgtcacgaccggtgctcgatttagtagtgtagatttgggtttgggggcgaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgt

SEQ ID NO: 549199 - DNA, 487 bp, Homo sapiens; identical to SEQ ID NO: 537220
  misc_feature: HIJSMM301BDT5L.16.53.E09.1.454.light.4.raw

SEQ ID NO: 549200 - DNA, 502 bp, Homo sapiens
  misc_feature: HIJSMM301DPGHM.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggccaaaactgaccgtcctaggtcagcccaa

SEQ ID NO: 549201 - DNA, 488 bp, Homo sapiens; identical to SEQ ID NO: 535861
  misc_feature: HIJSMM301CTDQI.14.55.E11.1.454.light.4.raw

SEQ ID NO: 549202 - DNA, 488 bp, Homo sapiens
  misc_feature: HIJSMM301ELZK0.47.60.F05.1.454.light.4.raw
agctcacgtacacgaccggtgctcgatttagtacgtcatcagggaaagggggaggaactgctcagttaggaccctttagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccat

SEQ ID NO: 549203 - DNA, 503 bp, Homo sapiens
  misc_feature: HIJSMM301B878M.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactcactgtcact

SEQ ID NO: 549204 - DNA, 444 bp, Homo sapiens; identical to SEQ ID NO: 540477
  misc_feature: HIJSMM301EI2LM.17.21.B10.1.454.light.4.raw

SEQ ID NO: 549205 - DNA, 447 bp, Homo sapiens; identical to SEQ ID NO: 535201
  misc_feature: HIJSMM301BJ3F7.18.9.A09.1.454.light.4.raw

SEQ ID NO: 549206 - DNA, 499 bp, Homo sapiens; identical to SEQ ID NO: 547591
  misc_feature: HIJSMM301DVBJC.43.34.D01.1.454.light.4.raw

SEQ ID NO: 549207 - DNA, 469 bp, Homo sapiens
  misc_feature: HIJSMM301EZCEP.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 549208 - DNA, 497 bp, Homo sapiens; identical to SEQ ID NO: 538061
  misc_feature: HIJSMM301A0MPS.16.46.E02.1.454.light.4.raw

SEQ ID NO: 549209 - DNA, 486 bp, Homo sapiens
  misc_feature: HIJSMM301E0O6M.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacga

SEQ ID NO: 549210 - DNA, 485 bp, Homo sapiens
  misc_feature: HIJSMM301EPFM6.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatct

SEQ ID NO: 549211 - DNA, 504 bp, Homo sapiens
  misc_feature: HIJSMM301BYZGN.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 549212 - DNA, 494 bp, Homo sapiens
  misc_feature: HIJSMM301CJDEP.40.57.F02.1.454.light.4.raw
tctagcgactcacgaccggtgctcgatttagctcgatatagttgggtttggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcgggaccgacgagtggagtgtcaaacgaacg

SEQ ID NO: 549213 - DNA, 498 bp, Homo sapiens
  misc_feature: HIJSMM301BTS69.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgcccctcggtcactctgttccccg

SEQ ID NO: 549214 - DNA, 494 bp, Homo sapiens; identical to SEQ ID NO: 534992
  misc_feature: HIJSMM301C6S1Z.9.1.A01.1.454.light.4.raw

SEQ ID NO: 549215 - DNA, 476 bp, Homo sapiens
  misc_feature: HIJSMM301EI3BW.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtcctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 549216 - DNA, 468 bp, Homo sapiens
  misc_feature: HIJSMM301BLM1P.49.78.H01.1.454.light.4.raw
agtcgagagacacgaccggtgctcgatttagtgtgagtagtttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagatattgcaacatattactgtcaacagtatgatagtctcccgctcactttcggcggggggaccaaggtggagatcaagcgaa

SEQ ID NO: 549217 - DNA, 500 bp, Homo sapiens
  misc_feature: HIJSMM301BK7KE.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactc

SEQ ID NO: 549218 - DNA, 495 bp, Homo sapiens
  misc_feature: HIJSMM301A4W0N.26.11.A11.1.454.light.4.raw
agactatactcacgaccggtgctcgatttagctacgactgcgagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 549219 - DNA, 494 bp, Homo sapiens
  misc_feature: HIJSMM301D4PV6.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggggacttttggccaggggaccaagctggagatcaaacgaactgtggctgcaccatctgtcttc

SEQ ID NO: 549220 - DNA, 487 bp, Homo sapiens; identical to SEQ ID NO: 536536
  misc_feature: HIJSMM301AS65Q.26.45.E01.1.454.light.4.raw

SEQ ID NO: 549221 - DNA, 486 bp, Homo sapiens; identical to SEQ ID NO: 537792
  misc_feature: HIJSMM301BE9IS.46.26.C04.1.454.light.4.raw

SEQ ID NO: 549222 - DNA, 531 bp, Homo sapiens
  misc_feature: HIJSMM301EK6S9.13.53.E09.1.454.light.4.raw
tcacgtactacacgaccggtgctcgatttagagagagtgtgttgggtttgggggaggtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaaacggtggaaagtacaagacggaaacgtcgttagggctcggcacccaactctcgttcttctatctttccccgtcccc

SEQ ID NO: 549223 - DNA, 500 bp, Homo sapiens; identical to SEQ ID NO: 541228
  misc_feature: HIJSMM301CX4VU.13.11.A11.1.454.light.4.raw

SEQ ID NO: 549224 - DNA, 460 bp, Homo sapiens; identical to SEQ ID NO: 539553
  misc_feature: HIJSMM301AZHVM.11.86.H09.1.454.light.4.raw

SEQ ID NO: 549225 - DNA, 508 bp, Homo sapiens; identical to SEQ ID NO: 545298
  misc_feature: HIJSMM301DYAGU.8.42.D09.1.454.light.4.raw

SEQ ID NO: 549226 - DNA, 482 bp, Homo sapiens
  misc_feature: HIJSMM301BTHDL.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcgagggaccagggtggagatcagacgaa

SEQ ID NO: 549227 - DNA, 495 bp, Homo sapiens
  misc_feature: HIJSMM301CQTDR.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 549228 - DNA, 481 bp, Homo sapiens
  misc_feature: HIJSMM301ELW3J.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcgggagggaccgaagctgaccgtcctaagtcagcccaac

SEQ ID NO: 549229 - DNA, 476 bp, Homo sapiens
  misc_feature: HIJSMM301B988H.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggagggaccaaggtggagatcaaacgaactgtggctgca

SEQ ID NO: 549230 - DNA, 445 bp, Homo sapiens
  misc_feature: HIJSMM301DQ7PV.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagttttgggtgtttgggtgttcggcggagggaccaagctgaccgtcctaagtcagcccaaggctgccccctcggtcactctgttcccaccctcctccgtgtctgat

SEQ ID NO: 549231 - DNA, 466 bp, Homo sapiens
  misc_feature: HIJSMM301DGBGL.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatcaaacgaa

SEQ ID NO: 549232 - DNA, 477 bp, Homo sapiens; identical to SEQ ID NO: 541557
  misc_feature: HIJSMM301AOTV5.51.44.D11.1.454.light.4.raw

SEQ ID NO: 549233 - DNA, 509 bp, Homo sapiens
  misc_feature: HIJSMM301CN33X.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctgccccctcggtcactctgttccca

SEQ ID NO: 549234 - DNA, 484 bp, Homo sapiens; identical to SEQ ID NO: 535400
  misc_feature: HIJSMM301BOBXC.46.26.C04.1.454.light.4.raw

SEQ ID NO: 549235 - DNA, 454 bp, Homo sapiens; identical to SEQ ID NO: 535005
  misc_feature: HIJSMM301EIMPK.19.86.H09.1.454.light.4.raw

SEQ ID NO: 549236 - DNA, 495 bp, Homo sapiens
  misc_feature: HIJSMM301AX4E5.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccccactgtcactcttcg

SEQ ID NO: 549237 - DNA, 444 bp, Homo sapiens; identical to SEQ ID NO: 535192
  misc_feature: HIJSMM301CBDH1.5.9.A09.1.454.light.4.raw

SEQ ID NO: 549238 - DNA, 504 bp, Homo sapiens; identical to SEQ ID NO: 535935
  misc_feature: HIJSMM301DJBA8.18.78.H01.1.454.light.4.raw

SEQ ID NO: 549239 - DNA, 486 bp, Homo sapiens; identical to SEQ ID NO: 535043
  misc_feature: HIJSMM301D0D5S.46.35.D02.1.454.light.4.raw

SEQ ID NO: 549240 - DNA, 494 bp, Homo sapiens; identical to SEQ ID NO: 534992
  misc_feature: HIJSMM301EIY3Y.9.1.A01.1.454.light.4.raw

SEQ ID NO: 549241 - DNA, 486 bp, Homo sapiens; identical to SEQ ID NO: 536323
  misc_feature: HIJSMM301ALEQJ.10.2.A02.1.454.light.4.raw

SEQ ID NO: 549242 - DNA, 389 bp, Homo sapiens
  misc_feature: HIJSMM301B5H9Q.41.78.H01.1.454.light.4.raw
tctatactatcacgaccggtgctcgatttagtgtgagtagtttgggtttgggggaaagaggccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtaatggtaagtttcacctctaactttcggcggagggaccaaggtggagatcaaacggaactgtggctgcaccatctgtcttcatcttcccgccatcctgaatagtataga

SEQ ID NO: 549243 - DNA, 492 bp, Homo sapiens
  misc_feature: HIJSMM301E3OHT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgagatgttgggtttattactgcatgcaagctctacaaactccttacacttttggccaggggaccaaagctggagatcaaacgaactgtgg

SEQ ID NO: 549244 - DNA, 468 bp, Homo sapiens
  misc_feature: HIJSMM301C4XEY.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaattcaaacgaa

SEQ ID NO: 549245 - DNA, 490 bp, Homo sapiens; identical to SEQ ID NO: 535526
  misc_feature: HIJSMM301D5BCH.26.78.H01.1.454.light.4.raw

SEQ ID NO: 549246 - DNA, 505 bp, Homo sapiens; identical to SEQ ID NO: 535503
  misc_feature: HIJSMM301BID9C.8.28.C06.1.454.light.4.raw

SEQ ID NO: 549247 - DNA, 447 bp, Homo sapiens; identical to SEQ ID NO: 535020
  misc_feature: HIJSMM301DYMQZ.18.9.A09.1.454.light.4.raw

SEQ ID NO: 549248 - DNA, 454 bp, Homo sapiens; identical to SEQ ID NO: 534964
  misc_feature: HIJSMM301C3P25.19.86.H09.1.454.light.4.raw

SEQ ID NO: 549249 - DNA, 502 bp, Homo sapiens
  misc_feature: HIJSMM301EQSJY.21.22.B11.1.454.light.4.raw
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggngttcggcggagggaccaaactgaccgtcctaggtcagcccaa

SEQ ID NO: 549250 - DNA, 481 bp, Homo sapiens; identical to SEQ ID NO: 535993
  misc_feature: HIJSMM301APP7N.21.25.C03.1.454.light.4.raw

SEQ ID NO: 549251 - DNA, 500 bp, Homo sapiens
  misc_feature: HIJSMM301AV4W7.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaacggtggagatcaaacgaactgtggctgcaccatctgtcttcatcttccccg

SEQ ID NO: 549252 - DNA, 474 bp, Homo sapiens
  misc_feature: HIJSMM301A6RZU.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtaatgatagtctcccgctcactttcggcggggggaccgaaggtaggaggatcaagcgaaa

SEQ ID NO: 549253 - DNA, 511 bp, Homo sapiens
  misc_feature: HIJSMM301DM85L.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaagtccggggtccctgaccgattcagtggcaggcgggtctgggacagatttcactctcaccatcagcagcctgcaggctgaagatgtggcagttttattactgtcaactagttttctcgggcgttcggccgaacgggaccaaggtaggaaagtacaaacgaactgtggctgcaccatctgtcttcatcttccccg

SEQ ID NO: 549254 - DNA, 460 bp, Homo sapiens
  misc_feature: HIJSMM301CH41O.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatggcaccctgaatggtccttgtgtggttttcggcggagggaccaagctgaccgtcctaggtcagcccaaggctgccccctcggtcactctgttcccaccctcctcgtatctctcg

SEQ ID NO: 549255 - DNA, 520 bp, Homo sapiens; identical to SEQ ID NO: 540293
  misc_feature: HIJSMM301EGSI0.27.23.C01.1.454.light.4.raw

SEQ ID NO: 549256 - DNA, 488 bp, Homo sapiens; identical to SEQ ID NO: 537124
  misc_feature: HIJSMM301EX0MH.11.25.C03.1.454.light.4.raw

SEQ ID NO: 549257 - DNA, 520 bp, Homo sapiens; identical to SEQ ID NO: 537173
  misc_feature: HIJSMM301CKWTY.27.23.C01.1.454.light.4.raw

SEQ ID NO: 549258 - DNA, 444 bp, Homo sapiens; identical to SEQ ID NO: 535192
  misc_feature: HIJSMM301A62ZS.5.9.A09.1.454.light.4.raw

SEQ ID NO: 549259 - DNA, 489 bp, Homo sapiens
  misc_feature: HIJSMM301EU0V0.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcacctctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccca

SEQ ID NO: 549260 - DNA, 485 bp, Homo sapiens
  misc_feature: HIJSMM301BWDK2.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggccaagctgaccgtcctaggtcagcccaaggctcgccccctcggtcta

SEQ ID NO: 549261 - DNA, 496 bp, Homo sapiens; identical to SEQ ID NO: 537925
  misc_feature: HIJSMM301C03FJ.22.14.B03.1.454.light.4.raw

SEQ ID NO: 549262 - DNA, 505 bp, Homo sapiens; identical to SEQ ID NO: 538422
  misc_feature: HIJSMM301BPDXJ.19.78.H01.1.454.light.4.raw

SEQ ID NO: 549263 - DNA, 485 bp, Homo sapiens; identical to SEQ ID NO: 539315
  misc_feature: HIJSMM301CFU48.3.88.H11.1.454.light.4.raw

SEQ ID NO: 549264 - DNA, 455 bp, Homo sapiens
  misc_feature: HIJSMM301ETSGD.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctccacgagagta

SEQ ID NO: 549265 - DNA, 489 bp, Homo sapiens; identical to SEQ ID NO: 541702
  misc_feature: HIJSMM301BNY09.10.72.G06.1.454.light.4.raw

SEQ ID NO: 549266 - DNA, 505 bp, Homo sapiens; identical to SEQ ID NO: 539292
  misc_feature: HIJSMM301D0I50.19.85.H08.1.454.light.4.raw

SEQ ID NO: 549267 - DNA, 506 bp, Homo sapiens
  misc_feature: HIJSMM301B9ES0.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctggt

SEQ ID NO: 549268 - DNA, 492 bp, Homo sapiens; identical to SEQ ID NO: 539815
  misc_feature: HIJSMM301BX03R.51.81.H04.1.454.light.4.raw

SEQ ID NO: 549269 - DNA, 489 bp, Homo sapiens
  misc_feature: HIJSMM301CQ6I0.17.26.C04.1.454.light.4.raw
  modified_base (416)..(416): a, c, t, g, unknown or other
  modified_base (426)..(426): a, c, t, g, unknown or other
cgtagactagcacgaccggtgctcgatttagtctagcgacttttggggtttgggggagtctcagtcaggacacagcatggacatgagggtccccgcctcagctcctggggcgtcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaagcccctaacgctcctgatctttgctgcatccagtttgcaaagtggggtcccttcaaggttcagtggcagtgggatctggggacagattttcactctcaccatcagcagtctgcaacctgaagattttgcaacttactactgtcaacngagttacaanaccctcggctcactttcggcggagggaccaaggtggagatcaaacgaactgtggctgcaccat

SEQ ID NO: 549270 - DNA, 484 bp, Homo sapiens
  misc_feature: HIJSMM301ADC37.49.38.D05.1.454.light.4.raw
agtcgagagacacgaccggtgctcgatttagtatctgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacg

SEQ ID NO: 549271 - DNA, 512 bp, Homo sapiens
  misc_feature: HIJSMM301BCHXJ.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgcactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 549272 - DNA, 488 bp, Homo sapiens
  misc_feature: HIJSMM301AGTMD.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccgaaagctgaccgtcctaggtcagcccaaggctgccccctccggtcta

SEQ ID NO: 549273 - DNA, 422 bp, Homo sapiens; identical to SEQ ID NO: 447881
  misc_feature: HIJSMM301D7N7S.9.34.D01.1.454.light.4.raw

SEQ ID NO: 549274 - DNA, 492 bp, Homo sapiens; identical to SEQ ID NO: 537666
  misc_feature: HIJSMM301BT1D2.43.33.C11.1.454.light.4.raw

SEQ ID NO: 549275 - DNA, 498 bp, Homo sapiens
  misc_feature: HIJSMM301B1F1D.51.78.H01.1.454.light.4.raw
cgatcgtatacacgaccggtgctcgatttagtgtgagtagtttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgcccctcggtcactctcg

SEQ ID NO: 549276 - DNA, 487 bp, Homo sapiens
  misc_feature: HIJSMM301C2DQ2.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggaggaccaaggtggagatcaaacgaactgtggctgcaccatctgtt

SEQ ID NO: 549277 - DNA, 484 bp, Homo sapiens; identical to SEQ ID NO: 536162
  misc_feature: HIJSMM301AE2B6.13.59.F04.1.454.light.4.raw

SEQ ID NO: 549278 - DNA, 473 bp, Homo sapiens; identical to SEQ ID NO: 535262
  misc_feature: HIJSMM301B98TI.8.67.G01.1.454.light.4.raw

SEQ ID NO: 549279 - DNA, 487 bp, Homo sapiens
  misc_feature: HIJSMM301AG4MV.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccgaggggaccgaacctggagat

SEQ ID NO: 549280 - DNA, 509 bp, Homo sapiens
  misc_feature: HIJSMM301DZRNB.48.23.C01.1.454.light.4.raw
agtatacatacacgaccggtgctcgatttagtacacgtgattagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaggctgccccccg

SEQ ID NO: 549281 - DNA, 518 bp, Homo sapiens
  misc_feature: HIJSMM301BPEQR.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccccctcctacg

SEQ ID NO: 549282 - DNA, 483 bp, Homo sapiens; identical to SEQ ID NO: 535317
  misc_feature: HIJSMM301DPZRF.4.1.A01.1.454.light.4.raw

SEQ ID NO: 549283 - DNA, 505 bp, Homo sapiens; identical to SEQ ID NO: 539292
  misc_feature: HIJSMM301C4DLD.19.85.H08.1.454.light.4.raw

SEQ ID NO: 549284 - DNA, 512 bp, Homo sapiens; identical to SEQ ID NO: 540898
  misc_feature: HIJSMM301AOUDC.17.33.C11.1.454.light.4.raw

SEQ ID NO: 549285 - DNA, 494 bp, Homo sapiens; identical to SEQ ID NO: 536477
  misc_feature: HIJSMM301DDCWB.22.5.A05.1.454.light.4.raw

SEQ ID NO: 549286 - DNA, 443 bp, Homo sapiens
  misc_feature: HIJSMM301DDYG4.9.9.A09.1.454.light.4.raw
  modified_base (435)..(435): a, c, t, g, unknown or other
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcanacgtatca

SEQ ID NO: 549287 - DNA, 497 bp, Homo sapiens; identical to SEQ ID NO: 536376
  misc_feature: HIJSMM301A8UTX.22.9.A09.1.454.light.4.raw

SEQ ID NO: 549288 - DNA, 519 bp, Homo sapiens
  misc_feature: HIJSMM301A561F.46.38.D05.1.454.light.4.raw
actagcagtacacgaccggtgctcgatttagtatctgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcgagcgtagtagtcggtactaccgtaccgaaagttaacgtttcggaccggacgggaaccgaagtcgtaggagatacgaaacgaactggtggtctgccactactcgttcg

SEQ ID NO: 549289 - DNA, 502 bp, Homo sapiens
  misc_feature: HIJSMM301AF17K.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtcccgtcgaccggttctctggctccaagtctggctcttccgcctccttggccatcactgggctcgaggctgacgatgaggctgattactactgtctgtcctatgacgacgacctacagactccggttttcggcggagggactaagctgaccgtccctaagtcagcccaac

SEQ ID NO: 549290 - DNA, 516 bp, Homo sapiens
  misc_feature: HIJSMM301CH6S1.41.78.H01.1.454.light.4.raw
tctatactatcacgaccggtgctcgatttagtgtgagtagtttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtctaggtcagcccaaggctgccccctcggtcactctgttccca

SEQ ID NO: 549291 - DNA, 493 bp, Homo sapiens; identical to SEQ ID NO: 535047
  misc_feature: HIJSMM301AHP75.16.53.E09.1.454.light.4.raw

SEQ ID NO: 549292 - DNA, 481 bp, Homo sapiens
  misc_feature: HIJSMM301DNE41.48.49.E05.1.454.light.4.raw
agtatacatacacgaccggtgctcgatttagagcgactagcaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtgg

SEQ ID NO: 549293 - DNA, 494 bp, Homo sapiens; identical to SEQ ID NO: 534992
  misc_feature: HIJSMM301A5OV4.9.1.A01.1.454.light.4.raw

SEQ ID NO: 549294 - DNA, 446 bp, Homo sapiens
  misc_feature: HIJSMM301AE2VU.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagtagctccaacatcgggaatcgctatgttgtacactggtaccagcagcttccaggaacagtccccaaacccctcatctatggtaatagtaatcggccctcaggggtcccgtgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctccctcagacgtatca

SEQ ID NO: 549295 - DNA, 485 bp, Homo sapiens
  misc_feature: HIJSMM301DS1KA.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactagtggctgcaccatctgtt

SEQ ID NO: 549296 - DNA, 468 bp, Homo sapiens
  misc_feature: HIJSMM301C85N4.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagactagaaatcaaacgaa

SEQ ID NO: 549297 - DNA, 383 bp, Homo sapiens; identical to SEQ ID NO: 447524
  misc_feature: HIJSMM301CYO03.41.26.C04.1.454.light.4.raw

SEQ ID NO: 549298 - DNA, 482 bp, Homo sapiens
  misc_feature: HIJSMM301CY1C6.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtaggaaatacaaacgaactagtgg

SEQ ID NO: 549299 - DNA, 488 bp, Homo sapiens; identical to SEQ ID NO: 541987
  misc_feature: HIJSMM301AR3FE.8.12.B01.1.454.light.4.raw

SEQ ID NO: 549300 - DNA, 441 bp, Homo sapiens; identical to SEQ ID NO: 534971
  misc_feature: HIJSMM301DI3U1.11.3.A03.1.454.light.4.raw

SEQ ID NO: 549301 - DNA, 463 bp, Homo sapiens
  misc_feature: HIJSMM301C2XFU.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcacctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 549302 - DNA, 443 bp, Homo sapiens
  misc_feature: HIJSMM301EXAHE.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctcctgtctgat

SEQ ID NO: 549303 - DNA, 486 bp, Homo sapiens
  misc_feature: HIJSMM301CP9M7.52.82.H05.1.454.light.4.raw
cgcagtacgacacgaccggtgctcgatttagtcgagctctctcgcgggcacgaccggtgctcgatttagtatagacatcaacacacaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggtaa

SEQ ID NO: 549304 - DNA, 494 bp, Homo sapiens
  misc_feature: HIJSMM301B33OZ.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacaccccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 549305 - DNA, 506 bp, Homo sapiens
  misc_feature: HIJSMM301AU01H.9.12.B01.1.454.light.4.raw
  modified_base (445)..(445): a, c, t, g, unknown or other
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggccaacgggaccgaaggtaggaaagtacaaacgaactagtggctgcacca

SEQ ID NO: 549306 - DNA, 507 bp, Homo sapiens
  misc_feature: HIJSMM301BQTDL.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccc

SEQ ID NO: 549307 - DNA, 497 bp, Homo sapiens; identical to SEQ ID NO: 536371
  misc_feature: HIJSMM301D47OZ.16.78.H01.1.454.light.4.raw

SEQ ID NO: 549308 - DNA, 505 bp, Homo sapiens; identical to SEQ ID NO: 535503
  misc_feature: HIJSMM301A1KUG.8.28.C06.1.454.light.4.raw

SEQ ID NO: 549309 - DNA, 479 bp, Homo sapiens; identical to SEQ ID NO: 542895
  misc_feature: HIJSMM301ARNDM.40.59.F04.1.454.light.4.raw

SEQ ID NO: 549310 - DNA, 498 bp, Homo sapiens
  misc_feature: HIJSMM301AKDWR.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcatt

SEQ ID NO: 549311 - DNA, 444 bp, Homo sapiens; identical to SEQ ID NO: 534993
  misc_feature: HIJSMM301AU7RP.5.9.A09.1.454.light.4.raw

SEQ ID NO: 549312 - DNA, 479 bp, Homo sapiens; identical to SEQ ID NO: 537141
  misc_feature: HIJSMM301BBAV3.7.76.G10.1.454.light.4.raw

SEQ ID NO: 549313 - DNA, 486 bp, Homo sapiens; identical to SEQ ID NO: 536555
  misc_feature: HIJSMM301A2UGG.26.23.C01.1.454.light.4.raw

SEQ ID NO: 549314 - DNA, 494 bp, Homo sapiens; identical to SEQ ID NO: 534994
  misc_feature: HIJSMM301CV2F4.27.78.H01.1.454.light.4.raw

SEQ ID NO: 549315 - DNA, 468 bp, Homo sapiens
  misc_feature: HIJSMM301CATVH.51.38.D05.1.454.light.4.raw
cgatcgtatacacgaccggtgctcgatttagtatctgatagttgggtttgggatagttgggtttgggggctttgcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcagggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 549316 - DNA, 487 bp, Homo sapiens; identical to SEQ ID NO: 538190
  misc_feature: HIJSMM301CPG6M.47.70.G04.1.454.light.4.raw

SEQ ID NO: 549317 - DNA, 486 bp, Homo sapiens
  misc_feature: HIJSMM301ER1LF.41.10.A10.1.454.light.4.raw
  modified_base (393)..(393): a, c, t, g, unknown or other
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtnttactgtcatcagagtcgtagtttacctcaaacgttcggccaagggaccaaggtggaaatcaaacgaactgtggctgcaccatctgtcttcat

SEQ ID NO: 549318 - DNA, 377 bp, Homo sapiens; identical to SEQ ID NO: 536071
  misc_feature: HIJSMM301EWAW9.40.9.A09.1.454.light.4.raw

SEQ ID NO: 549319 - DNA, 494 bp, Homo sapiens
  misc_feature: HIJSMM301EU7AL.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaatcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggtagggaccaagctgaccgtcctaggtcagcccaaggctgcccctcggtcactctgttcccaccctctcgagtgcgtct

SEQ ID NO: 549320 - DNA, 484 bp, Homo sapiens
  misc_feature: HIJSMM301CUQ9H.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaccta

SEQ ID NO: 549321 - DNA, 490 bp, Homo sapiens
  misc_feature: HIJSMM301AONRB.49.86.H09.1.454.light.4.raw
agtcgagagacacgaccggtgctcgatttagtgctatagacttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 549322 - DNA, 507 bp, Homo sapiens
  misc_feature: HIJSMM301A5REL.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccagggaccgacacgtagaaatagagacgaactagtggcgtgcaccactctgtcttctatcttcccgt

SEQ ID NO: 549323 - DNA, 497 bp, Homo sapiens; identical to SEQ ID NO: 545786
  misc_feature: HIJSMM301D5YCH.48.59.F04.1.454.light.4.raw

SEQ ID NO: 549324 - DNA, 488 bp, Homo sapiens
  misc_feature: HIJSMM301AD1FO.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggttcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtaccaaggtggacatcagacgaactgtggctgcaccat

SEQ ID NO: 549325 - DNA, 511 bp, Homo sapiens
  misc_feature: HIJSMM301C8CQK.22.30.C08.1.454.light.4.raw
  modified_base (455)..(455): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccatttggcagccacacaagggggtcggatccctgatcgcttctcgggctccagctctggggccgagcgctactcaccatctccagcctccagtctgaagatgaggctgactattactagtcagacatgggacgctggcgtctggctgttcggcggagggaccaagcngaccgctacggtcagcccaaggctgcccctcggtcactctgttcccacctctcacg

SEQ ID NO: 549326 - DNA, 454 bp, Homo sapiens; identical to SEQ ID NO: 534964
  misc_feature: HIJSMM301CLQ67.19.86.H09.1.454.light.4.raw

SEQ ID NO: 549327 - DNA, 455 bp, Homo sapiens; identical to SEQ ID NO: 549264
  misc_feature: HIJSMM301EVYEQ.19.86.H09.1.454.light.4.raw

SEQ ID NO: 549328 - DNA, 506 bp, Homo sapiens; identical to SEQ ID NO: 536038
  misc_feature: HIJSMM301ANHXE.7.71.G05.1.454.light.4.raw

SEQ ID NO: 549329 - DNA, 503 bp, Homo sapiens
  misc_feature: HIJSMM301AXWSK.48.85.H08.1.454.light.4.raw
agtatacatacacgaccggtgctcgatttagtatcactcagtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccctcct

SEQ ID NO: 549330 - DNA, 491 bp, Homo sapiens; identical to SEQ ID NO: 535294
  misc_feature: HIJSMM301DONFP.16.68.G02.1.454.light.4.raw

SEQ ID NO: 549331 - DNA, 497 bp, Homo sapiens; identical to SEQ ID NO: 536807
  misc_feature: HIJSMM301DNSGO.10.37.D04.1.454.light.4.raw

SEQ ID NO: 549332 - DNA, 486 bp, Homo sapiens
  misc_feature: HIJSMM301CI2OU.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccgaaactgaccgtcctaggtcagcccaaggctgccccctcggtcactctgttcccaccctcctctacgtgagct

SEQ ID NO: 549333 - DNA, 486 bp, Homo sapiens; identical to SEQ ID NO: 535290
  misc_feature: HIJSMM301B7K6J.3.12.B01.1.454.light.4.raw

SEQ ID NO: 549334 - DNA, 500 bp, Homo sapiens
  misc_feature: HIJSMM301AYOOI.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagttttattattgtcagcaatattatattcctcctcagacgttcggccaagggaccaaggtggaaatcaaacgaaactgtggctgcaccca

SEQ ID NO: 549335 - DNA, 479 bp, Homo sapiens
  misc_feature: HIJSMM301B70IJ.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcgggtggagatcagacgaactgtggctgcaccatctgtctt

SEQ ID NO: 549336 - DNA, 510 bp, Homo sapiens
  misc_feature: HIJSMM301BWS9X.15.59.F04.1.454.light.4.raw
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcattttcggtcttcggcggagggaccaagctgaccgtcctaggtcagccccaaggctgcccccctggt

SEQ ID NO: 549337 - DNA, 486 bp, Homo sapiens; identical to SEQ ID NO: 538918
  misc_feature: HIJSMM301CCNPY.47.38.D05.1.454.light.4.raw

SEQ ID NO: 549338 - DNA, 487 bp, Homo sapiens; identical to SEQ ID NO: 537208
  misc_feature: HIJSMM301DZ1CD.3.55.E11.1.454.light.4.raw

SEQ ID NO: 549339 - DNA, 505 bp, Homo sapiens
  misc_feature: HIJSMM301D1VN8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaaactgtggctgcaccatctgtcttctatcttccccg

SEQ ID NO: 549340 - DNA, 501 bp, Homo sapiens
  misc_feature: HIJSMM301CAQQA.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccgaagggaccgaacggtggaagtacaaacggaaactgtggctgcaccatctgtcttcatcttcccgt

SEQ ID NO: 549341 - DNA, 444 bp, Homo sapiens; identical to SEQ ID NO: 537971
  misc_feature: HIJSMM301AXFMY.2.76.G10.1.454.light.4.raw

SEQ ID NO: 549342 - DNA, 494 bp, Homo sapiens
  misc_feature: HIJSMM301BGVZ9.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactagtggctgcaccatctgtcttcat

SEQ ID NO: 549343 - DNA, 496 bp, Homo sapiens; identical to SEQ ID NO: 545011
  misc_feature: HIJSMM301EKAD1.22.86.H09.1.454.light.4.raw

SEQ ID NO: 549344 - DNA, 502 bp, Homo sapiens
  misc_feature: HIJSMM301DXP5O.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaacttgggaccgaggtcaccgtcctaggtcagcccaaggccaacccactgtcta

SEQ ID NO: 549345 - DNA, 478 bp, Homo sapiens
  misc_feature: HIJSMM301AM4HU.5.70.G04.1.454.light.4.raw
atcagacacgcacgaccggtgctcgatttagtgtagtgtgaagggaaagggggagtcagacccagtcaggacacagcatggacatgagggtccccgctcagctcctgggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgca

SEQ ID NO: 549346 - DNA, 485 bp, Homo sapiens; identical to SEQ ID NO: 548974
  misc_feature: HIJSMM301BQ88G.48.77.G11.1.454.light.4.raw

SEQ ID NO: 549347 - DNA, 483 bp, Homo sapiens; identical to SEQ ID NO: 536691
  misc_feature: HIJSMM301CL451.17.26.C04.1.454.light.4.raw

SEQ ID NO: 549348 - DNA, 505 bp, Homo sapiens
  misc_feature: HIJSMM301BIW1B.48.70.G04.1.454.light.4.raw
agtatacatacacgaccggtgctcgatttagtgtagtgtgaagggaaagggggctacaacaggcaggcaggggcagcaagatggtgttggcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccaacgtggaaatcaaacgaactgtggctgcaccatctgtctt

SEQ ID NO: 549349 - DNA, 491 bp, Homo sapiens
  misc_feature: HIJSMM301DK56Y.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggtctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgt

SEQ ID NO: 549350 - DNA, 509 bp, Homo sapiens
  misc_feature: HIJSMM301DS054.48.59.F04.1.454.light.4.raw
agtatacatacacgaccggtgctcgatttagtacacacacttagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtctaggtcaacccaaggctgccccccg

SEQ ID NO: 549351 - DNA, 499 bp, Homo sapiens
  misc_feature: HIJSMM301AIZQV.51.60.F05.1.454.light.4.raw
cgatcgtatacacgaccggtgctcgatttagtacgtcatcagggaaagggggatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaaacgaactgtggctgcaccat

SEQ ID NO: 549352 - DNA, 494 bp, Homo sapiens; identical to SEQ ID NO: 534992
  misc_feature: HIJSMM301A01SF.9.1.A01.1.454.light.4.raw

SEQ ID NO: 549353 - DNA, 447 bp, Homo sapiens; identical to SEQ ID NO: 535950
  misc_feature: HIJSMM301AEG6G.18.9.A09.1.454.light.4.raw

SEQ ID NO: 549354 - DNA, 501 bp, Homo sapiens
  misc_feature: HIJSMM301BNXIG.43.71.G05.1.454.light.4.raw
tgtgagtagtcacgaccggtgctcgatttagtgtcgtcgcaagagagaggggggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagataaccgaactgtgctgcaccatctgtcttcatccttccccg

SEQ ID NO: 549355 - DNA, 485 bp, Homo sapiens
  misc_feature: HIJSMM301AL3VI.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacc

SEQ ID NO: 549356 - DNA, 502 bp, Homo sapiens
  misc_feature: HIJSMM301DQ8XE.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggcc

SEQ ID NO: 549357 - DNA, 432 bp, Homo sapiens
  misc_feature: HIJSMM301EULBL.18.9.A09.1.454.light.4.raw
tacgagtatgcacgaccggtgctcgatttagcgagacgcgcagggtcctgggcccagtctgtgctgacgcagccgccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggcccaaccctctgtcactctcgttcccaccctcctccatactcgta

SEQ ID NO: 549358 - DNA, 485 bp, Homo sapiens
  misc_feature: HIJSMM301DJ1K5.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggacaacggtggaaatacaaacgaactagtggctgcacca

SEQ ID NO: 549359 - DNA, 496 bp, Homo sapiens; identical to SEQ ID NO: 535541
  misc_feature: HIJSMM301CANYZ.3.33.C11.1.454.light.4.raw

SEQ ID NO: 549360 - DNA, 521 bp, Homo sapiens
  misc_feature: HIJSMM301C54D5.43.9.A09.1.454.light.4.raw
tgtgagtagtcacgaccggtgctcgatttagcgagacgcgcaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggtcggagggaccgaacgttgaccgtcctacggtcagcccaacggctgccccctccggtcactctgttcccgccctcccttcca

SEQ ID NO: 549361 - DNA, 487 bp, Homo sapiens; identical to SEQ ID NO: 537009
  misc_feature: HIJSMM301COL30.12.88.H11.1.454.light.4.raw

SEQ ID NO: 549362 - DNA, 504 bp, Homo sapiens
  misc_feature: HIJSMM301AFN3C.40.23.C01.1.454.light.4.raw
tctagcgactcacgaccggtgctcgatttagtacacgtgattagggattgggggggaggaactgctcagttaggacccacgagggaaccatggaagccccacgctcagcttcttcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactcggccgctctacttcggcgggacgggaccgaaggtaggagatacaacgaactgtggctgcaccatctgtcttc

SEQ ID NO: 549363 - DNA, 499 bp, Homo sapiens
  misc_feature: HIJSMM301DBBW2.9.81.H04.1.454.light.4.raw
tgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaacccactgtcact

SEQ ID NO: 549364 - DNA, 514 bp, Homo sapiens
  misc_feature: HIJSMM301BTZCU.8.28.C06.1.454.light.4.raw
  modified_base (480)..(480): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagcccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgtactttgctagtttatttctgtcagcagtctgaagactggccgttcactttcggcggagggaccaaggtggacctcaaacgaactgnggctgcaccatctgtcttcatccttcccgcattc

SEQ ID NO: 549365 - DNA, 497 bp, Homo sapiens; identical to SEQ ID NO: 544475
  misc_feature: HIJSMM301EQSTK.12.87.H10.1.454.light.4.raw

SEQ ID NO: 549366 - DNA, 484 bp, Homo sapiens; identical to SEQ ID NO: 535211
  misc_feature: HIJSMM301B4G2T.47.46.E02.1.454.light.4.raw

SEQ ID NO: 549367 - DNA, 479 bp, Homo sapiens
  misc_feature: HIJSMM301A2JQ0.40.59.F04.1.454.light.4.raw
tctagcgactcacgaccggtgctcgatttagtacacacacttagggattggggcctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccg

SEQ ID NO: 549368 - DNA, 494 bp, Homo sapiens; identical to SEQ ID NO: 535276
  misc_feature: HIJSMM301CL559.16.6.A06.1.454.light.4.raw

SEQ ID NO: 549369 - DNA, 490 bp, Homo sapiens
  misc_feature: HIJSMM301AVWG3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 549370 - DNA, 487 bp, Homo sapiens
  misc_feature: HIJSMM301C8GSA.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaaggctgaccgtcctaggtcagcccaaggctcg

SEQ ID NO: 549371 - DNA, 489 bp, Homo sapiens
  misc_feature: HIJSMM301CUTRV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgacggagatacagacgaactgtggctgcaccactctgtcttcta

SEQ ID NO: 549372 - DNA, 489 bp, Homo sapiens; identical to SEQ ID NO: 536013
  misc_feature: HIJSMM301AJPPD.26.23.C01.1.454.light.4.raw

SEQ ID NO: 549373 - DNA, 485 bp, Homo sapiens; identical to SEQ ID NO: 535653
  misc_feature: HIJSMM301EKXJL.47.62.F07.1.454.light.4.raw

SEQ ID NO: 549374 - DNA, 487 bp, Homo sapiens
  misc_feature: HIJSMM301CUCH0.40.37.D04.1.454.light.4.raw
tctagcgactcacgaccggtgctcgatttagtagcatactgttgggtttggggtgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttccttcggactttcggccctcggtccgacgagtggatgtcaaacgaa

SEQ ID NO: 549375 - DNA, 483 bp, Homo sapiens
  misc_feature: HIJSMM301DB1QB.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcacc

SEQ ID NO: 549376 - DNA, 485 bp, Homo sapiens
  misc_feature: HIJSMM301DZYJB.5.34.D01.1.454.light.4.raw
atcagacacgcacgaccggtgctcgatttagatcgtctgtgttggggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactggagattaaacgaactagtggctgcacca

SEQ ID NO: 549377 - DNA, 497 bp, Homo sapiens
  misc_feature: HIJSMM301EIEW9.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgctactctggggtcccagacagattcagcggcagtgggtcaggcactgatttcacactgaagatcagcagggtggaggctgaggatgttggggtttattactgcatgcaaggtacacactggcccgtcaccttcggccaaagggacacgactggagattaaacgaactgtggctgcacc

SEQ ID NO: 549378 - DNA, 488 bp, Homo sapiens; identical to SEQ ID NO: 535081
  misc_feature: HIJSMM301C7LLQ.26.23.C01.1.454.light.4.raw

SEQ ID NO: 549379 - DNA, 488 bp, Homo sapiens; identical to SEQ ID NO: 537260
  misc_feature: HIJSMM301ELJOB.47.70.G04.1.454.light.4.raw

SEQ ID NO: 549380 - DNA, 496 bp, Homo sapiens
  misc_feature: HIJSMM301D8RHJ.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaaggctggagatcaaccgaactgtggctgcaccatctgtt

SEQ ID NO: 549381 - DNA, 505 bp, Homo sapiens
  misc_feature: HIJSMM301CDDUR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccagactcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggccctgggaccaaagtggatatcaacgaactgtggctgcaccatctgtctt

SEQ ID NO: 549382 - DNA, 486 bp, Homo sapiens; identical to SEQ ID NO: 535043
  misc_feature: HIJSMM301AKDS8.46.35.D02.1.454.light.4.raw

SEQ ID NO: 549383 - DNA, 485 bp, Homo sapiens; identical to SEQ ID NO: 538533
  misc_feature: HIJSMM301CALV2.47.78.H01.1.454.light.4.raw

SEQ ID NO: 549384 - DNA, 478 bp, Homo sapiens
  misc_feature: HIJSMM301D4K6E.51.76.G10.1.454.light.4.raw
cgatcgtatacacgaccggtgctcgatttagtcactcatacaggggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 549385 - DNA, 492 bp, Homo sapiens
  misc_feature: HIJSMM301B1B24.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgtctgtatttctgtcagcagtatgtttcgcacctttcactttcggcggagggaccaaggtggagagcagacgaactgtggctgcacc

SEQ ID NO: 549386 - DNA, 505 bp, Homo sapiens; identical to SEQ ID NO: 535503
  misc_feature: HIJSMM301EYCVF.8.28.C06.1.454.light.4.raw

SEQ ID NO: 549387 - DNA, 490 bp, Homo sapiens; identical to SEQ ID NO: 535526
  misc_feature: HIJSMM301B4UAF.26.78.H01.1.454.light.4.raw

SEQ ID NO: 549388 - DNA, 503 bp, Homo sapiens; identical to SEQ ID NO: 536834
  misc_feature: HIJSMM301BFMEJ.2.35.D02.1.454.light.4.raw

SEQ ID NO: 549389 - DNA, 454 bp, Homo sapiens; identical to SEQ ID NO: 536347
  misc_feature: HIJSMM301AKWCP.19.86.H09.1.454.light.4.raw

SEQ ID NO: 549390 - DNA, 488 bp, Homo sapiens; identical to SEQ ID NO: 546043
  misc_feature: HIJSMM301EE953.13.87.H10.1.454.light.4.raw

SEQ ID NO: 549391 - DNA, 485 bp, Homo sapiens; identical to SEQ ID NO: 535501
  misc_feature: HIJSMM301CCEEO.3.10.A10.1.454.light.4.raw

SEQ ID NO: 549392 - DNA, 484 bp, Homo sapiens; identical to SEQ ID NO: 537427
  misc_feature: HIJSMM301C6JCV.26.78.H01.1.454.light.4.raw

SEQ ID NO: 549393 - DNA, 489 bp, Homo sapiens; identical to SEQ ID NO: 542061
  misc_feature: HIJSMM301EJKA4.15.8.A08.1.454.light.4.raw

SEQ ID NO: 549394 - DNA, 506 bp, Homo sapiens
  misc_feature: HIJSMM301AU805.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccta

SEQ ID NO: 549395 - DNA, 513 bp, Homo sapiens
  misc_feature: HIJSMM301AK7QC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcct

SEQ ID NO: 549396 - DNA, 507 bp, Homo sapiens
  misc_feature: HIJSMM301AUBAE.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaacgaactgtggctgcaccatctgtcttcta

SEQ ID NO: 549397 - DNA, 498 bp, Homo sapiens
  misc_feature: HIJSMM301BPS1P.48.56.F01.1.454.light.4.raw
agtatacatacacgaccggtgctcgatttagcagacgtctgaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgttcaccagtatggtagctcacctctaactttcggcggaggaccgaaggtggagatcaaacgaactagtggctgcaccatctgtt

SEQ ID NO: 549398 - DNA, 474 bp, Homo sapiens; identical to SEQ ID NO: 544751
  misc_feature: HIJSMM301AN4RU.3.38.D05.1.454.light.4.raw

SEQ ID NO: 549399 - DNA, 494 bp, Homo sapiens
  misc_feature: HIJSMM301CHF97.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcaaccgaactgtggctgcaccatctgt

SEQ ID NO: 549400 - DNA, 506 bp, Homo sapiens
  misc_feature: HIJSMM301CVJL0.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctggctcgagtctgaggacgaggctgattacttctgttgctcttgggcaactactgtcgtttgggtgttcggcggagggaccgaagttgaccgtcctaggtcagccaaggctgcccctcggtcactctgtt

SEQ ID NO: 549401 - DNA, 485 bp, Homo sapiens
  misc_feature: HIJSMM301B5WD7.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 549402 - DNA, 497 bp, Homo sapiens; identical to SEQ ID NO: 534982
  misc_feature: HIJSMM301EUQBM.26.80.H03.1.454.light.4.raw

SEQ ID NO: 549403 - DNA, 492 bp, Homo sapiens
  misc_feature: HIJSMM301B6G61.15.49.E05.1.454.light.4.raw
tctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactagtggctgcaccatctgtt

SEQ ID NO: 549404 - DNA, 508 bp, Homo sapiens; identical to SEQ ID NO: 536062
  misc_feature: HIJSMM301B33G5.11.57.F02.1.454.light.4.raw

SEQ ID NO: 549405 - DNA, 496 bp, Homo sapiens
  misc_feature: HIJSMM301BCQXH.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtctacgtcagcccaaggctgccccctcggtcactctcg

SEQ ID NO: 549406 - DNA, 481 bp, Homo sapiens; identical to SEQ ID NO: 535993
  misc_feature: HIJSMM301EXNYF.21.25.C03.1.454.light.4.raw

SEQ ID NO: 549407 - DNA, 506 bp, Homo sapiens; identical to SEQ ID NO: 542696
  misc_feature: HIJSMM301AW3HI.7.71.G05.1.454.light.4.raw

SEQ ID NO: 549408 - DNA, 506 bp, Homo sapiens
  misc_feature: HIJSMM301C889M.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactc

SEQ ID NO: 549409 - DNA, 509 bp, Homo sapiens
  misc_feature: HIJSMM301BT8BW.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgttccccg

SEQ ID NO: 549410 - DNA, 488 bp, Homo sapiens
  misc_feature: HIJSMM301BILBV.52.35.D02.1.454.light.4.raw
cgcagtacgacacgaccggtgctcgatttagcacacgatagttgggtttgggggaagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattattgtcagcactatggtaggtcacagtacacttttggccaggggaccaagctggagatcaaacgaactgtggctgcacca

SEQ ID NO: 549411 - DNA, 447 bp, Homo sapiens; identical to SEQ ID NO: 535201
  misc_feature: HIJSMM301DE17U.18.9.A09.1.454.light.4.raw

SEQ ID NO: 549412 - DNA, 486 bp, Homo sapiens
  misc_feature: HIJSMM301ETO9P.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagtccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 549413 - DNA, 444 bp, Homo sapiens; identical to SEQ ID NO: 536685
  misc_feature: HIJSMM301B23M6.10.76.G10.1.454.light.4.raw

SEQ ID NO: 549414 - DNA, 503 bp, Homo sapiens
  misc_feature: HIJSMM301C0Q90.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaaggctgccccctcggtca

SEQ ID NO: 549415 - DNA, 498 bp, Homo sapiens
  misc_feature: HIJSMM301B44G7.52.25.C03.1.454.light.4.raw
cgcagtacgacacgaccggtgctcgatttagtagtgtagatttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggt

SEQ ID NO: 549416 - DNA, 484 bp, Homo sapiens; identical to SEQ ID NO: 537878
  misc_feature: HIJSMM301CJDYY.17.34.D01.1.454.light.4.raw

SEQ ID NO: 549417 - DNA, 503 bp, Homo sapiens
  misc_feature: HIJSMM301BAJS6.48.26.C04.1.454.light.4.raw
agtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagcctgaccgtcctaggtcagcccaaggctgccccctc

SEQ ID NO: 549418 - DNA, 504 bp, Homo sapiens
  misc_feature: HIJSMM301BHO6N.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtca

SEQ ID NO: 549419 - DNA, 490 bp, Homo sapiens; identical to SEQ ID NO: 540409
  misc_feature: HIJSMM301D6346.15.8.A08.1.454.light.4.raw

SEQ ID NO: 549420 - DNA, 484 bp, Homo sapiens; identical to SEQ ID NO: 535400
  misc_feature: HIJSMM301BZA5S.46.26.C04.1.454.light.4.raw

SEQ ID NO: 549421 - DNA, 489 bp, Homo sapiens
  misc_feature: HIJSMM301CBFOQ.15.3.A03.1.454.light.4.raw
  modified_base (432)..(432): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtnttcctttacttcggcctgggaccaaagtggatatcaaacgaactgtggctgcaccat

SEQ ID NO: 549422 - DNA, 494 bp, Homo sapiens; identical to SEQ ID NO: 534992
  misc_feature: HIJSMM301BEFOT.9.1.A01.1.454.light.4.raw

SEQ ID NO: 549423 - DNA, 447 bp, Homo sapiens; identical to SEQ ID NO: 535201
  misc_feature: HIJSMM301D25TG.18.9.A09.1.454.light.4.raw

SEQ ID NO: 549424 - DNA, 488 bp, Homo sapiens
  misc_feature: HIJSMM301DQQQ9.13.36.D03.1.454.light.4.raw
  modified_base (221)..(221): a, c, t, g, unknown or other
tcacgtactacacgaccggtgctcgatttagctgcgtcacgatctctcttggggggtcgagagctctggggagggaactgctcagttaggacccacgacggaaccatggaagccccacgcgcagcttctcttcctcctgctactctggctcccagatactactggagaaatagtgctgacgcagtctccagtcaccctgtctgtgtctccaggggaaatancaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagatttgtcagtctattactgtcagcagtatagttactggagaaccttcggccaagggacacgactggagattaaaggaa

SEQ ID NO: 549425 - DNA, 504 bp, Homo sapiens
  misc_feature: HIJSMM301CKI32.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaaggaccaggtgaagtcaagcgaactgtggctgcaccatctgtcttcatcttcccgcc

SEQ ID NO: 549426 - DNA, 511 bp, Homo sapiens
  misc_feature: HIJSMM301EV5GD.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 549427 - DNA, 444 bp, Homo sapiens; identical to SEQ ID NO: 544367
  misc_feature: HIJSMM301BP9ZO.2.76.G10.1.454.light.4.raw

SEQ ID NO: 549428 - DNA, 488 bp, Homo sapiens; identical to SEQ ID NO: 541868
  misc_feature: HIJSMM301CJR03.14.55.E11.1.454.light.4.raw

SEQ ID NO: 549429 - DNA, 517 bp, Homo sapiens
  misc_feature: HIJSMM301EISYM.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcgccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacg

SEQ ID NO: 549430 - DNA, 488 bp, Homo sapiens
  misc_feature: HIJSMM301DOD9S.9.75.G09.1.454.light.4.raw
tgatacgtctcacgaccggtgctcgatttagtatagacatcagggggcaggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtctt

SEQ ID NO: 549431 - DNA, 384 bp, Homo sapiens
  misc_feature: HIJSMM301BNKW0.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagtttcacctctaactttcggcggagggaccaaggtggagatcaaacgaactgtggctgcaccatctgtcttcatcttcccgccatctgaatagtataga

SEQ ID NO: 549432 - DNA, 505 bp, Homo sapiens; identical to SEQ ID NO: 536254
  misc_feature: HIJSMM301DJ8MF.7.71.G05.1.454.light.4.raw

SEQ ID NO: 549433 - DNA, 343 bp, Homo sapiens
  misc_feature: HIJSMM301AQF8I.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggtcactctgttcccaccctcctccgagcgaga

SEQ ID NO: 549434 - DNA, 497 bp, Homo sapiens
  misc_feature: HIJSMM301B40C7.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggaccaagctggagatcaaacgaactgtggctgcaccatctgcttcat

SEQ ID NO: 549435 - DNA, 485 bp, Homo sapiens; identical to SEQ ID NO: 536576
  misc_feature: HIJSMM301EEEH3.46.35.D02.1.454.light.4.raw

SEQ ID NO: 549436 - DNA, 485 bp, Homo sapiens
  misc_feature: HIJSMM301BZI79.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgcaacaatatgatatttattctccagcgttcggccaggggaccaaggtggaagtcaagcgaactgtggctgcaccatct

SEQ ID NO: 549437 - DNA, 503 bp, Homo sapiens; identical to SEQ ID NO: 538884
  misc_feature: HIJSMM301D6CO4.27.78.H01.1.454.light.4.raw

SEQ ID NO: 549438 - DNA, 503 bp, Homo sapiens; identical to SEQ ID NO: 546983
  misc_feature: HIJSMM301BKS6D.21.22.B11.1.454.light.4.raw

SEQ ID NO: 549439 - DNA, 509 bp, Homo sapiens; identical to SEQ ID NO: 547302
  misc_feature: HIJSMM301BEU5Z.4.57.F02.1.454.light.4.raw

SEQ ID NO: 549440 - DNA, 495 bp, Homo sapiens; identical to SEQ ID NO: 537716
  misc_feature: HIJSMM301CW5NS.22.14.B03.1.454.light.4.raw

SEQ ID NO: 549441 - DNA, 487 bp, Homo sapiens
  misc_feature: HIJSMM301C27IV.43.60.F05.1.454.light.4.raw
tgtgagtagtcacgaccggtgctcgatttagtacgtcatcagggaaaggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagatttgcaacttattactgtctacaagattcttcttaccctcggacgttcggccgacgggaccgacggtcggagtgtctaacgacgaactgtggctgcaccat

SEQ ID NO: 549442 - DNA, 515 bp, Homo sapiens
  misc_feature: HIJSMM301CVOV6.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaactaagaggtacaaacgaaacctagtggctgcgaccaactctgtcttctatt

SEQ ID NO: 549443 - DNA, 496 bp, Homo sapiens
  misc_feature: HIJSMM301CO40T.43.34.D01.1.454.light.4.raw
tgtgagtagtcacgaccggtgctcgatttagatcgtctgtgttgggtttggggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcgggaattgggacgacggtcaccgtcctaggtcagcccaaggccaa

SEQ ID NO: 549444 - DNA, 510 bp, Homo sapiens
  misc_feature: HIJSMM301AUT2H.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccgt

SEQ ID NO: 549445 - DNA, 490 bp, Homo sapiens
  misc_feature: HIJSMM301ELBA9.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 549446 - DNA, 487 bp, Homo sapiens; identical to SEQ ID NO: 535358
  misc_feature: HIJSMM301AWTPZ.47.70.G04.1.454.light.4.raw

SEQ ID NO: 549447 - DNA, 495 bp, Homo sapiens; identical to SEQ ID NO: 537415
  misc_feature: HIJSMM301DM9ZP.4.27.C05.1.454.light.4.raw

SEQ ID NO: 549448 - DNA, 512 bp, Homo sapiens; identical to SEQ ID NO: 541300
  misc_feature: HIJSMM301DANMZ.17.33.C11.1.454.light.4.raw

SEQ ID NO: 549449 - DNA, 485 bp, Homo sapiens
  misc_feature: HIJSMM301C8O52.12.33.C11.1.454.light.4.raw
atacgacgtacacgaccggtgctcgatttagagtgagctcgttgggtttggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 549450 - DNA, 492 bp, Homo sapiens; identical to SEQ ID NO: 537509
  misc_feature: HIJSMM301ALAHJ.13.46.E02.1.454.light.4.raw

SEQ ID NO: 549451 - DNA, 491 bp, Homo sapiens
  misc_feature: HIJSMM301BYG6C.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggacctccagcctgaggacgaggctgactattactgctcagcatgggacagcagcctcacaaattggatgttcggcggaggaccaagctgaccgtcctaggtcagcccaa

SEQ ID NO: 549452 - DNA, 481 bp, Homo sapiens; identical to SEQ ID NO: 535993
  misc_feature: HIJSMM301BTIZ4.21.25.C03.1.454.light.4.raw

SEQ ID NO: 549453 - DNA, 505 bp, Homo sapiens
  misc_feature: HIJSMM301C4AEH.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaacgaactagtggctgcaccatctgtcttcta

SEQ ID NO: 549454 - DNA, 472 bp, Homo sapiens; identical to SEQ ID NO: 535992
  misc_feature: HIJSMM301EM2N3.11.76.G10.1.454.light.4.raw

SEQ ID NO: 549455 - DNA, 464 bp, Homo sapiens; identical to SEQ ID NO: 536640
  misc_feature: HIJSMM301CKQ0R.26.78.H01.1.454.light.4.raw

SEQ ID NO: 549456 - DNA, 476 bp, Homo sapiens
  misc_feature: HIJSMM301BRODE.49.73.G07.1.454.light.4.raw
agtcgagagacacgaccggtgctcgatttagctctacgctcagggcacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaagctcctgatcctcgatgcatccactttggaaacaggggtcccatcaagttcagtggaagtggctctgggacagtattttactttcaccatcagcagactgcagcctgaagatattgcaacatattactgtcaacagtatgatagtctcccgctcactttcggcggaac

SEQ ID NO: 549457 - DNA, 506 bp, Homo sapiens
  misc_feature: HIJSMM301CC3RW.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccg

SEQ ID NO: 549458 - DNA, 480 bp, Homo sapiens; identical to SEQ ID NO: 547848
  misc_feature: HIJSMM301AY4UA.7.83.H06.1.454.light.4.raw

SEQ ID NO: 549459 - DNA, 480 bp, Homo sapiens
  misc_feature: HIJSMM301D67KA.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggcc

SEQ ID NO: 549460 - DNA, 487 bp, Homo sapiens
  misc_feature: HIJSMM301AY8DO.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtggctgcacc

SEQ ID NO: 549461 - DNA, 493 bp, Homo sapiens; identical to SEQ ID NO: 539015
  misc_feature: HIJSMM301CHXP7.27.78.H01.1.454.light.4.raw

SEQ ID NO: 549462 - DNA, 493 bp, Homo sapiens; identical to SEQ ID NO: 536769
  misc_feature: HIJSMM301DICL7.19.83.H06.1.454.light.4.raw

SEQ ID NO: 549463 - DNA, 503 bp, Homo sapiens
  misc_feature: HIJSMM301BTSCR.43.23.C01.1.454.light.4.raw
tgtgagtagtcacgaccggtgctcgatttagtacacgtgattagggattggggggggtcgtcaggaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggggacgacggtcaccgtcctaggtcagcccaagggccaacccca

SEQ ID NO: 549464 - DNA, 508 bp, Homo sapiens; identical to SEQ ID NO: 535835
  misc_feature: HIJSMM301B6FBB.8.34.D01.1.454.light.4.raw

SEQ ID NO: 549465 - DNA, 496 bp, Homo sapiens
  misc_feature: HIJSMM301ADB5F.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccgaaggtggagatcaaacgaactgtggctgcaccatctgtctt

SEQ ID NO: 549466 - DNA, 477 bp, Homo sapiens; identical to SEQ ID NO: 545166
  misc_feature: HIJSMM301CD510.5.28.C06.1.454.light.4.raw

SEQ ID NO: 549467 - DNA, 504 bp, Homo sapiens
  misc_feature: HIJSMM301BDOOM.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcacttctgcacagtctctgaggcctcctatgagctgacacagccaccctcggtgtcagtgtccccacggacaaacggaccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcg

SEQ ID NO: 549468 - DNA, 495 bp, Homo sapiens
  misc_feature: HIJSMM301BZLYQ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatactgtcagcagtataataactggcctccacggtacacttttggccaggggaccaagctggagatcaaacgaactgtggctgcaccatctgt

SEQ ID NO: 549469 - DNA, 479 bp, Homo sapiens
  misc_feature: HIJSMM301EI83V.48.37.D04.1.454.light.4.raw
agtatacatacacgaccggtgctcgatttagtagcatactgttgggtttgggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaa

SEQ ID NO: 549470 - DNA, 484 bp, Homo sapiens; identical to SEQ ID NO: 535240
  misc_feature: HIJSMM301BO12K.47.60.F05.1.454.light.4.raw

SEQ ID NO: 549471 - DNA, 444 bp, Homo sapiens; identical to SEQ ID NO: 535594
  misc_feature: HIJSMM301AY80H.9.9.A09.1.454.light.4.raw

SEQ ID NO: 549472 - DNA, 487 bp, Homo sapiens; identical to SEQ ID NO: 536272
  misc_feature: HIJSMM301EF0IG.17.25.C03.1.454.light.4.raw

SEQ ID NO: 549473 - DNA, 447 bp, Homo sapiens; identical to SEQ ID NO: 535201
  misc_feature: HIJSMM301AH5TD.18.9.A09.1.454.light.4.raw

SEQ ID NO: 549474 - DNA, 503 bp, Homo sapiens
  misc_feature: HIJSMM301ATMO0.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatacaaacgaactagtggcgtgcaccatctgtcttctatcttccccg

SEQ ID NO: 549475 - DNA, 501 bp, Homo sapiens
  misc_feature: HIJSMM301DABE3.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgcca

SEQ ID NO: 549476 - DNA, 495 bp, Homo sapiens
  misc_feature: HIJSMM301D0RDA.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcggaacgttcggcccagggaccacagtggatatcaggcgaacgtgtggctgcaccatctgtctt

SEQ ID NO: 549477 - DNA, 491 bp, Homo sapiens; identical to SEQ ID NO: 535194
  misc_feature: HIJSMM301A5EHT.26.78.H01.1.454.light.4.raw

SEQ ID NO: 549478 - DNA, 444 bp, Homo sapiens; identical to SEQ ID NO: 535594
  misc_feature: HIJSMM301BLYIV.9.9.A09.1.454.light.4.raw

SEQ ID NO: 549479 - DNA, 441 bp, Homo sapiens; identical to SEQ ID NO: 535074
  misc_feature: HIJSMM301CTHHX.11.3.A03.1.454.light.4.raw

SEQ ID NO: 549480 - DNA, 484 bp, Homo sapiens; identical to SEQ ID NO: 535400
  misc_feature: HIJSMM301DH19I.46.26.C04.1.454.light.4.raw

SEQ ID NO: 549481 - DNA, 522 bp, Homo sapiens
  misc_feature: HIJSMM301B7ZIM.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctcggtcactctgttcccaccctcctctctctcga

SEQ ID NO: 549482 - DNA, 496 bp, Homo sapiens; identical to SEQ ID NO: 535423
  misc_feature: HIJSMM301C3ZQL.3.33.C11.1.454.light.4.raw

SEQ ID NO: 549483 - DNA, 467 bp, Homo sapiens
  misc_feature: HIJSMM301ELSV8.48.48.E04.1.454.light.4.raw
agtatacatacacgaccggtgctcgatttagagagcgtcacagagagaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 549484 - DNA, 505 bp, Homo sapiens
  misc_feature: HIJSMM301BH1A1.10.70.G04.1.454.light.4.raw
catagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgtttgggtgttcggcggagggaccaagctgaccgtccttagtcagcccaaggctgccccctcggtcactctgttcccaccctcctcca

SEQ ID NO: 549485 - DNA, 494 bp, Homo sapiens; identical to SEQ ID NO: 535276
  misc_feature: HIJSMM301BO2XO.16.6.A06.1.454.light.4.raw

SEQ ID NO: 549486 - DNA, 493 bp, Homo sapiens
  misc_feature: HIJSMM301BH2KP.48.71.G05.1.454.light.4.raw
agtatacatacacgaccggtgctcgatttagtgtcgtcgcaagagagaggggaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 549487 - DNA, 507 bp, Homo sapiens
  misc_feature: HIJSMM301DM719.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgagatgtggcagtttattactgtcagcaatattttcgtgctccgtacacttttggccaggggacccaggtggagatcagacgactgtgtactgcaacgatactttgttacggttactaatcttaccgta

SEQ ID NO: 549488 - DNA, 486 bp, Homo sapiens; identical to SEQ ID NO: 535523
  misc_feature: HIJSMM301D0D9V.22.73.G07.1.454.light.4.raw

SEQ ID NO: 549489 - DNA, 490 bp, Homo sapiens
  misc_feature: HIJSMM301ADBAU.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgt

SEQ ID NO: 549490 - DNA, 495 bp, Homo sapiens; identical to SEQ ID NO: 541651
  misc_feature: HIJSMM301C05E9.16.78.H01.1.454.light.4.raw

SEQ ID NO: 549491 - DNA, 489 bp, Homo sapiens
  misc_feature: HIJSMM301EIDPT.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagagtcagacgaactgtggctgcaccatctgtcttca

SEQ ID NO: 549492 - DNA, 444 bp, Homo sapiens; identical to SEQ ID NO: 535594
  misc_feature: HIJSMM301B7IHN.9.9.A09.1.454.light.4.raw

SEQ ID NO: 549493 - DNA, 492 bp, Homo sapiens
  misc_feature: HIJSMM301A32XW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtatttgcagtctattactgtcagcagtatggtcacgtcccaagtaactttggccgaggggaccaagctggagatacaaacgaactgtgctgcaccatcttcg

SEQ ID NO: 549494 - DNA, 464 bp, Homo sapiens
  misc_feature: HIJSMM301AMYX7.49.8.A08.1.454.light.4.raw
agtcgagagacacgaccggtgctcgatttagcatactctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 549495 - DNA, 464 bp, Homo sapiens
  misc_feature: HIJSMM301BC09X.53.38.D05.1.454.light.4.raw
cgcgtatacacacgaccggtgctcgatttagtatctgatagttgggtttggggctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccaccctcctctcgtactgcg

SEQ ID NO: 549496 - DNA, 502 bp, Homo sapiens; identical to SEQ ID NO: 536604
  misc_feature: HIJSMM301AN7ML.27.78.H01.1.454.light.4.raw

SEQ ID NO: 549497 - DNA, 486 bp, Homo sapiens; identical to SEQ ID NO: 535290
  misc_feature: HIJSMM301CPUBG.3.12.B01.1.454.light.4.raw

SEQ ID NO: 549498 - DNA, 464 bp, Homo sapiens; identical to SEQ ID NO: 537982
  misc_feature: HIJSMM301DQTYY.17.28.C06.1.454.light.4.raw

SEQ ID NO: 549499 - DNA, 487 bp, Homo sapiens; identical to SEQ ID NO: 535299
  misc_feature: HIJSMM301B6TLX.21.55.E11.1.454.light.4.raw

SEQ ID NO: 549500 - DNA, 444 bp, Homo sapiens; identical to SEQ ID NO: 534993
  misc_feature: HIJSMM301CDBEF.5.9.A09.1.454.light.4.raw

SEQ ID NO: 549501 - DNA, 360 bp, Homo sapiens
  misc_feature: HIJSMM301CP8RS.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccaccctcctcagtgcgtct

SEQ ID NO: 549502 - DNA, 504 bp, Homo sapiens; identical to SEQ ID NO: 535077
  misc_feature: HIJSMM301AQJU8.8.28.C06.1.454.light.4.raw

SEQ ID NO: 549503 - DNA, 510 bp, Homo sapiens; identical to SEQ ID NO: 535855
  misc_feature: HIJSMM301B6XJ6.17.33.C11.1.454.light.4.raw

SEQ ID NO: 549504 - DNA, 468 bp, Homo sapiens
  misc_feature: HIJSMM301C3F7K.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacatacccctccatacacttttggccaggggaccaagctggagatcagacgaac

SEQ ID NO: 549505 - DNA, 484 bp, Homo sapiens
  misc_feature: HIJSMM301AN920.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagagatgaggctgactattattgtcaatcaacagacagtagtgggaaatatgtggtattcggcggagggaccaaactgaccgtcctaggtcagcccaaggctgccccccg

SEQ ID NO: 549506 - DNA, 484 bp, Homo sapiens
  misc_feature: HIJSMM301D6DI3.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtgctgcaccatct

SEQ ID NO: 549507 - DNA, 491 bp, Homo sapiens
  misc_feature: HIJSMM301AJC3U.5.57.F02.1.454.light.4.raw
atcagacacgcacgaccggtgctcgatttagctcgatatagttgggtttgggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 549508 - DNA, 482 bp, Homo sapiens
  misc_feature: HIJSMM301CJ4AV.49.34.D01.1.454.light.4.raw
agtcgagagacacgaccggtgctcgatttagatcgtctgtgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacagggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacca

SEQ ID NO: 549509 - DNA, 508 bp, Homo sapiens
  misc_feature: HIJSMM301D0GHN.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatcttgtttgggttctgagtcgggcctccggggtccctgacaggttcagtggcagtggatcaggcacagtattttacgctagaaaatcagtagggtggaggctgaggatggttggggtttattacttgcatgacaagttctaacaaacttcctactacttttggccgacgggaaccaaggctggagatacaaacgaactgtggctgca

SEQ ID NO: 549510 - DNA, 517 bp, Homo sapiens
  misc_feature: HIJSMM301EP8TQ.48.29.C07.1.454.light.4.raw
agtatacatacacgaccggtgctcgatttagagtgctacgaagggaaagggggctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgccccctcggtcactctgttcccaccctcct

SEQ ID NO: 549511 - DNA, 510 bp, Homo sapiens
  misc_feature: HIJSMM301A6T7X.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccatgtcactctcg

SEQ ID NO: 549512 - DNA, 514 bp, Homo sapiens; identical to SEQ ID NO: 541418
  misc_feature: HIJSMM301BF499.17.33.C11.1.454.light.4.raw

SEQ ID NO: 549513 - DNA, 486 bp, Homo sapiens; identical to SEQ ID NO: 536323
  misc_feature: HIJSMM301DHV5I.10.2.A02.1.454.light.4.raw

SEQ ID NO: 549514 - DNA, 484 bp, Homo sapiens
  misc_feature: HIJSMM301DDZXG.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagatttgcaacttactactgtcaacagagttacggtaccccgtacacttttggccaggggaccaaactggacatcaaacgaactgtggctgcaccatctgt

SEQ ID NO: 549515 - DNA, 484 bp, Homo sapiens
  misc_feature: HIJSMM301D4PV9.48.27.C05.1.454.light.4.raw
  modified_base (476)..(476): a, c, t, g, unknown or other
agtatacatacacgaccggtgctcgatttagacgcgatcgaagggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaaggaccaaggtggaagtacaaacgaactagtggntgcaccat

SEQ ID NO: 549516 - DNA, 444 bp, Homo sapiens; identical to SEQ ID NO: 535192
  misc_feature: HIJSMM301BUQXB.5.9.A09.1.454.light.4.raw

SEQ ID NO: 549517 - DNA, 500 bp, Homo sapiens; identical to SEQ ID NO: 543863
  misc_feature: HIJSMM301B1RZ9.12.26.C04.1.454.light.4.raw

SEQ ID NO: 549518 - DNA, 500 bp, Homo sapiens
  misc_feature: HIJSMM301DNF38.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtattacacttatgtcttcggaattgggacgacggtcaccgtcctaggtcagcccaaggcccaacccta

SEQ ID NO: 549519 - DNA, 494 bp, Homo sapiens; identical to SEQ ID NO: 535629
  misc_feature: HIJSMM301DPPJ2.4.27.C05.1.454.light.4.raw

SEQ ID NO: 549520 - DNA, 511 bp, Homo sapiens
  misc_feature: HIJSMM301ANHET.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgtcggtccgaaggaccgaaggtaggaaagtacaaacgaactagtggctgcaccaactctgtcttctatcttccccg

SEQ ID NO: 549521 - DNA, 486 bp, Homo sapiens; identical to SEQ ID NO: 535043
  misc_feature: HIJSMM301C5LQ5.46.35.D02.1.454.light.4.raw

SEQ ID NO: 549522 - DNA, 516 bp, Homo sapiens
  misc_feature: HIJSMM301BZW0V.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctagtcagccaagctgccccctcggtcactctgttcccgcct

SEQ ID NO: 549523 - DNA, 501 bp, Homo sapiens; identical to SEQ ID NO: 536142
  misc_feature: HIJSMM301AZIGH.15.1.A01.1.454.light.4.raw

SEQ ID NO: 549524 - DNA, 500 bp, Homo sapiens; identical to SEQ ID NO: 540012
  misc_feature: HIJSMM301A771I.52.34.D01.1.454.light.4.raw

SEQ ID NO: 549525 - DNA, 502 bp, Homo sapiens; identical to SEQ ID NO: 537816
  misc_feature: HIJSMM301CSKBG.19.78.H01.1.454.light.4.raw

SEQ ID NO: 549526 - DNA, 497 bp, Homo sapiens; identical to SEQ ID NO: 535579
  misc_feature: HIJSMM301CW1EY.26.26.C04.1.454.light.4.raw

SEQ ID NO: 549527 - DNA, 489 bp, Homo sapiens
  misc_feature: HIJSMM301EUA7S.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactagtggctgcaccat

SEQ ID NO: 549528 - DNA, 502 bp, Homo sapiens
  misc_feature: HIJSMM301CRQHX.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtccaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaaactgtggctgcaccatctgtcttcatcttcccg

SEQ ID NO: 549529 - DNA, 464 bp, Homo sapiens
  misc_feature: HIJSMM301DYLEM.17.28.C06.1.454.light.4.raw
  modified_base (445)..(445): a, c, t, g, unknown or other
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccgggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccnccctcctccttagtctacg

SEQ ID NO: 549530 - DNA, 496 bp, Homo sapiens; identical to SEQ ID NO: 535109
  misc_feature: HIJSMM301B4MRF.16.78.H01.1.454.light.4.raw

SEQ ID NO: 549531 - DNA, 496 bp, Homo sapiens; identical to SEQ ID NO: 535109
  misc_feature: HIJSMM301DR3TF.16.78.H01.1.454.light.4.raw

SEQ ID NO: 549532 - DNA, 437 bp, Homo sapiens
  misc_feature: HIJSMM301B5RBM.48.38.D05.1.454.light.4.raw
agtatacatacacgaccggtgctcgatttagtatctgatagttgggtttggggggtgtggtggtctccactccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagtggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggtcactctgttcccaccctcctctatgtatact

SEQ ID NO: 549533 - DNA, 502 bp, Homo sapiens
  misc_feature: HIJSMM301B5ZX2.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaatagaggtcaacgaactagtggctgcaccatctgtcttcat

SEQ ID NO: 549534 - DNA, 492 bp, Homo sapiens; identical to SEQ ID NO: 536360
  misc_feature: HIJSMM301ESTHA.11.81.H04.1.454.light.4.raw

SEQ ID NO: 549535 - DNA, 495 bp, Homo sapiens
  misc_feature: HIJSMM301C3RCQ.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggtccgggggaccaagctggagatcaaacgaactgtggctgcaccatctgtcttcta

SEQ ID NO: 549536 - DNA, 494 bp, Homo sapiens
  misc_feature: HIJSMM301B0G36.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggtaccaagctggagatcaaccgaactgtggctgcaccatctgt

SEQ ID NO: 549537 - DNA, 476 bp, Homo sapiens; identical to SEQ ID NO: 541471
  misc_feature: HIJSMM301EROK8.13.4.A04.1.454.light.4.raw

SEQ ID NO: 549538 - DNA, 504 bp, Homo sapiens
  misc_feature: HIJSMM301COSZ6.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccta

SEQ ID NO: 549539 - DNA, 507 bp, Homo sapiens
  misc_feature: HIJSMM301BXBD3.48.38.D05.1.454.light.4.raw
agtatacatacacgaccggtgctcgatttagtatctgatagttggggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaacgcccccaaactcttgatttatgagatcactaagcggccctcaggcgtttctaatcgcttctctggctccaagtctggcaacacggcctccctgacaatctctgggctccaggctggaggacgaggctgattattattgctgctcatatgcaggtggtactacttgggtgttcggcaggagggaccaagctgaccgtcctaggtcacgcccaaggctcgtccccccg

SEQ ID NO: 549540 - DNA, 454 bp, Homo sapiens; identical to SEQ ID NO: 535005
  misc_feature: HIJSMM301EA59S.19.86.H09.1.454.light.4.raw

SEQ ID NO: 549541 - DNA, 496 bp, Homo sapiens
  misc_feature: HIJSMM301C4O34.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgcta

SEQ ID NO: 549542 - DNA, 447 bp, Homo sapiens
  misc_feature: HIJSMM301B0V59.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 549543 - DNA, 490 bp, Homo sapiens; identical to SEQ ID NO: 538273
  misc_feature: HIJSMM301C1MX9.16.73.G07.1.454.light.4.raw

SEQ ID NO: 549544 - DNA, 484 bp, Homo sapiens; identical to SEQ ID NO: 535400
  misc_feature: HIJSMM301AI3R4.46.26.C04.1.454.light.4.raw

SEQ ID NO: 549545 - DNA, 501 bp, Homo sapiens; identical to SEQ ID NO: 536867
  misc_feature: HIJSMM301C6LON.5.86.H09.1.454.light.4.raw

SEQ ID NO: 549546 - DNA, 487 bp, Homo sapiens; identical to SEQ ID NO: 536206
  misc_feature: HIJSMM301DHXUH.47.38.D05.1.454.light.4.raw

SEQ ID NO: 549547 - DNA, 377 bp, Homo sapiens; identical to SEQ ID NO: 536071
  misc_feature: HIJSMM301ECCZO.40.9.A09.1.454.light.4.raw

SEQ ID NO: 549548 - DNA, 485 bp, Homo sapiens; identical to SEQ ID NO: 536576
  misc_feature: HIJSMM301DX2FC.46.35.D02.1.454.light.4.raw

SEQ ID NO: 549549 - DNA, 488 bp, Homo sapiens; identical to SEQ ID NO: 538017
  misc_feature: HIJSMM301DQKG7.4.59.F04.1.454.light.4.raw

SEQ ID NO: 549550 - DNA, 492 bp, Homo sapiens
  misc_feature: HIJSMM301BCQ6Q.48.30.C08.1.454.light.4.raw
agtatacatacacgaccggtgctcgatttagtctgacgtcaaagggaagggggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtggctgcaccatctgtcttcatcttcccgccat

SEQ ID NO: 549551 - DNA, 460 bp, Homo sapiens
  misc_feature: HIJSMM301D32JE.48.73.G07.1.454.light.4.raw
agtatacatacacgaccggtgctcgatttagctctacgctcagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 549552 - DNA, 469 bp, Homo sapiens
  misc_feature: HIJSMM301DAS5W.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctcgagtgccacttttggcgggggaccaaggtggacatcaacgaa

SEQ ID NO: 549553 - DNA, 491 bp, Homo sapiens
  misc_feature: HIJSMM301D7918.19.71.G05.1.454.light.4.raw
tactctcgtgcacgaccggtgctcgatttagtgtcgtcgcaagagagaggggggaggtacaacaggcaggcaggggcagaaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtgg

SEQ ID NO: 549554 - DNA, 487 bp, Homo sapiens
  misc_feature: HIJSMM301AW3UE.49.75.G09.1.454.light.4.raw
agtcgagagacacgaccggtgctcgatttagtatagacatcaggggcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttctaccatcagcaggctgcagcctgaagatattgcaacatattactgtcaacagtatgatagtctcccgctcactttcggtcgggggaccggaacgtagggtaggatccacgcgaaccgtacgtgggtcgtcgtcga

SEQ ID NO: 549555 - DNA, 509 bp, Homo sapiens; identical to SEQ ID NO: 539269
  misc_feature: HIJSMM301EEEYH.4.57.F02.1.454.light.4.raw

SEQ ID NO: 549556 - DNA, 481 bp, Homo sapiens; identical to SEQ ID NO: 535993
  misc_feature: HIJSMM301D12LJ.21.25.C03.1.454.light.4.raw

SEQ ID NO: 549557 - DNA, 484 bp, Homo sapiens; identical to SEQ ID NO: 535400
  misc_feature: HIJSMM301DMSEM.46.26.C04.1.454.light.4.raw

SEQ ID NO: 549558 - DNA, 504 bp, Homo sapiens
  misc_feature: HIJSMM301CVTQT.48.34.D01.1.454.light.4.raw
agtatacatacacgaccggtgctcgatttagatcgtctgtgttgggtttggggaagagaggcctggggagcccagctgtgctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctggtcacg

SEQ ID NO: 549559 - DNA, 489 bp, Homo sapiens; identical to SEQ ID NO: 536013
  misc_feature: HIJSMM301AIDT1.26.23.C01.1.454.light.4.raw

SEQ ID NO: 549560 - DNA, 490 bp, Homo sapiens
  misc_feature: HIJSMM301CNE1Y.26.23.C01.1.454.light.4.raw
  modified_base (477)..(477): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccgaggggaccaaggtggaagtcaagcgaactgtggntgcaccatctgtt

SEQ ID NO: 549561 - DNA, 486 bp, Homo sapiens; identical to SEQ ID NO: 535043
  misc_feature: HIJSMM301AH8UO.46.35.D02.1.454.light.4.raw

SEQ ID NO: 549562 - DNA, 495 bp, Homo sapiens
  misc_feature: HIJSMM301BN3UD.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactggtggctgcaccatctgtcttcatcttccccg

SEQ ID NO: 549563 - DNA, 498 bp, Homo sapiens
  misc_feature: HIJSMM301C1JWE.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 549564 - DNA, 487 bp, Homo sapiens
  misc_feature: HIJSMM301A5KGH.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatacaaacgaactgtggctgcaccatctgtcttcatt

SEQ ID NO: 549565 - DNA, 499 bp, Homo sapiens; identical to SEQ ID NO: 543887
  misc_feature: HIJSMM301ELRMU.10.65.F10.1.454.light.4.raw

SEQ ID NO: 549566 - DNA, 490 bp, Homo sapiens
  misc_feature: HIJSMM301CL52M.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatggcgacatccgtgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctgagatcaaacgaactgtggctgcacca

SEQ ID NO: 549567 - DNA, 475 bp, Homo sapiens
  misc_feature: HIJSMM301BQ1N0.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtgg

SEQ ID NO: 549568 - DNA, 489 bp, Homo sapiens
  misc_feature: HIJSMM301DJGJ8.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacc

SEQ ID NO: 549569 - DNA, 521 bp, Homo sapiens
  misc_feature: HIJSMM301AH0H5.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcgagggtggaggctggaggattggtttggggtttattactgcatgacaaactacacgacggccgctctacgtttcggcgggaggaccgaaggtggaggatacgaaacgaactggtggcgtgcaccatctgtt

SEQ ID NO: 549570 - DNA, 484 bp, Homo sapiens; identical to SEQ ID NO: 535240
  misc_feature: HIJSMM301DUMNZ.47.60.F05.1.454.light.4.raw

SEQ ID NO: 549571 - DNA, 494 bp, Homo sapiens
  misc_feature: HIJSMM301AUQC3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacgaacgacggagatacagacgaactagtggcgtgcaccaactctgtcttcta

SEQ ID NO: 549572 - DNA, 478 bp, Homo sapiens
  misc_feature: HIJSMM301D1JWG.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgctaacttacttctgtcaacagagttacagttccctcactttcggccctgggaccatagtggatatcaaacgaactgtggctgcaccatctgtctt

SEQ ID NO: 549573 - DNA, 499 bp, Homo sapiens
  misc_feature: HIJSMM301AHTAR.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtccctcgcccgattctctggctccaagtctggcacctcagcctccctggccatcactgggctccaggctgatgatgaggctgattattactgccagtcctatgacactaatctcagtggtctgggggtcttcggcggagggaccaggctgaccgtcgtgggtcagcccaa

SEQ ID NO: 549574 - DNA, 493 bp, Homo sapiens
  misc_feature: HIJSMM301BTLIR.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactgtggc

SEQ ID NO: 549575 - DNA, 500 bp, Homo sapiens
  misc_feature: HIJSMM301EKTZ2.51.87.H10.1.454.light.4.raw
cgatcgtatacacgaccggtgctcgatttagcagtactgcgttgggtttggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctcctcgatcaccttcggccaagggacacgactggagaataaacgaactgtggctgcaccatctgtcttcta

SEQ ID NO: 549576 - DNA, 506 bp, Homo sapiens
  misc_feature: HIJSMM301BVI7M.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctgggaccaaagtggatatcaaacgaactgtggctgcaccatctgtctt

SEQ ID NO: 549577 - DNA, 472 bp, Homo sapiens; identical to SEQ ID NO: 536302
  misc_feature: HIJSMM301ERA2I.18.76.G10.1.454.light.4.raw

SEQ ID NO: 549578 - DNA, 503 bp, Homo sapiens; identical to SEQ ID NO: 536834
  misc_feature: HIJSMM301AXSRJ.2.35.D02.1.454.light.4.raw

SEQ ID NO: 549579 - DNA, 447 bp, Homo sapiens; identical to SEQ ID NO: 535201
  misc_feature: HIJSMM301D3I9Z.18.9.A09.1.454.light.4.raw

SEQ ID NO: 549580 - DNA, 482 bp, Homo sapiens
  misc_feature: HIJSMM301D8KW5.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcccttgggaccaatgtggatatcaaacgaactgtggctgcaccatctgt

SEQ ID NO: 549581 - DNA, 447 bp, Homo sapiens; identical to SEQ ID NO: 535020
  misc_feature: HIJSMM301CUEYE.18.9.A09.1.454.light.4.raw

SEQ ID NO: 549582 - DNA, 532 bp, Homo sapiens
  misc_feature: HIJSMM301CPGO0.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctcgcccgattctcaggctccctccgttggggcgaaagctgccctgacactgtctggtgtgcagcctgaggacgaggctgactattactgcctactctactttggtggtgctgtgtctattcggtcggagggaccgaacgctgaccgtcttaacgttacacgcccgaacggacgtcgccccctcccggtcctacctctcgttcccta

SEQ ID NO: 549583 - DNA, 517 bp, Homo sapiens
  misc_feature: HIJSMM301ESJMD.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttccaccctct

SEQ ID NO: 549584 - DNA, 494 bp, Homo sapiens; identical to SEQ ID NO: 535629
  misc_feature: HIJSMM301BVF7I.4.27.C05.1.454.light.4.raw

SEQ ID NO: 549585 - DNA, 493 bp, Homo sapiens; identical to SEQ ID NO: 536534
  misc_feature: HIJSMM301AWBU0.43.72.G06.1.454.light.4.raw

SEQ ID NO: 549586 - DNA, 487 bp, Homo sapiens; identical to SEQ ID NO: 536206
  misc_feature: HIJSMM301BKEB7.47.38.D05.1.454.light.4.raw

SEQ ID NO: 549587 - DNA, 483 bp, Homo sapiens
  misc_feature: HIJSMM301EV2C3.4.71.G05.1.454.light.4.raw
agcactgtagcacgaccggtgctcgatttagtgtcgtcgcaagagagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccgggtccctgaccgattcagtggcagcgggtctgggacagatttcactctcaccatcaacagcctgcaggctgaagatgtggcagtttattactgtcagcagtattatataactcccttcactttcggcgagggaccaaggtgagatcaaacgaa

SEQ ID NO: 549588 - DNA, 508 bp, Homo sapiens; identical to SEQ ID NO: 537954
  misc_feature: HIJSMM301CKRJK.4.57.F02.1.454.light.4.raw

SEQ ID NO: 549589 - DNA, 508 bp, Homo sapiens; identical to SEQ ID NO: 536388
  misc_feature: HIJSMM301CRVPV.11.57.F02.1.454.light.4.raw

SEQ ID NO: 549590 - DNA, 502 bp, Homo sapiens
  misc_feature: HIJSMM301BSUOA.43.67.G01.1.454.light.4.raw
tgtgagtagtcacgaccggtgctcgatttagagtatacatattgggtttggggggccgtttgcattgtgaactgagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgtatactccgccgacgttcgccggggaccaccgtggaaatcaacgaa

SEQ ID NO: 549591 - DNA, 506 bp, Homo sapiens
  misc_feature: HIJSMM301BID9S.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtca

SEQ ID NO: 549592 - DNA, 484 bp, Homo sapiens; identical to SEQ ID NO: 535287
  misc_feature: HIJSMM301EH1HJ.13.56.F01.1.454.light.4.raw

SEQ ID NO: 549593 - DNA, 302 bp, Homo sapiens
  misc_feature: HIJSMM301BPHM0.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttg

SEQ ID NO: 549594 - DNA, 441 bp, Homo sapiens
  misc_feature: HIJSMM301DEQD9.11.3.A03.1.454.light.4.raw
cgagagataccacgaccggtgctcgatttagagagcgtcacagggtcctgggcccagtctgtgctgacgcagccgccctcagtgtctggggccccagggcagagggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 549595 - DNA, 508 bp, Homo sapiens
  misc_feature: HIJSMM301E0WCT.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcctcgggaccgaaagtaggagtatcaaacgaaactagtggcgtgcaccactct

SEQ ID NO: 549596 - DNA, 486 bp, Homo sapiens; identical to SEQ ID NO: 540300
  misc_feature: HIJSMM301D6OGO.47.70.G04.1.454.light.4.raw

SEQ ID NO: 549597 - DNA, 516 bp, Homo sapiens
  misc_feature: HIJSMM301CPX2J.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcatcttccccg

SEQ ID NO: 549598 - DNA, 500 bp, Homo sapiens; identical to SEQ ID NO: 548609
  misc_feature: HIJSMM301EGZER.17.27.C05.1.454.light.4.raw

SEQ ID NO: 549599 - DNA, 498 bp, Homo sapiens; identical to SEQ ID NO: 536896
  misc_feature: HIJSMM301ADEH1.48.34.D01.1.454.light.4.raw

SEQ ID NO: 549600 - DNA, 495 bp, Homo sapiens
  misc_feature: HIJSMM301EKA7F.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggaccaaggtggagttcaaacgaactgtggctgcaccatctgtcttcatt

SEQ ID NO: 549601 - DNA, 489 bp, Homo sapiens
  misc_feature: HIJSMM301AD5LT.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagccctgaagattttggaacttattattgtcaacagggtaacagtttcccgctcaccttcggcggagggaccaaggtggagatgaaagaactgtggctgcaccat

SEQ ID NO: 549602 - DNA, 441 bp, Homo sapiens; identical to SEQ ID NO: 535074
  misc_feature: HIJSMM301C66G8.11.3.A03.1.454.light.4.raw

SEQ ID NO: 549603 - DNA, 491 bp, Homo sapiens
  misc_feature: HIJSMM301D4J6D.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattctgtcacgacgtgggacagtggcgactgcgaagtcttcggccggagggaccaagctgaccgtcctggtcagcccaaggctgccccctc

SEQ ID NO: 549604 - DNA, 496 bp, Homo sapiens
  misc_feature: HIJSMM301DPU1F.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggtttcggcggagggaccaagctgaccgtcctaggtcagcccaaggctgccccctcggt

SEQ ID NO: 549605 - DNA, 489 bp, Homo sapiens; identical to SEQ ID NO: 535386
  misc_feature: HIJSMM301EHT66.12.51.E07.1.454.light.4.raw

SEQ ID NO: 549606 - DNA, 486 bp, Homo sapiens; identical to SEQ ID NO: 535043
  misc_feature: HIJSMM301BJRQ5.46.35.D02.1.454.light.4.raw

SEQ ID NO: 549607 - DNA, 485 bp, Homo sapiens; identical to SEQ ID NO: 536040
  misc_feature: HIJSMM301BMM8I.15.1.A01.1.454.light.4.raw

SEQ ID NO: 549608 - DNA, 491 bp, Homo sapiens; identical to SEQ ID NO: 535294
  misc_feature: HIJSMM301BGYQB.16.68.G02.1.454.light.4.raw

SEQ ID NO: 549609 - DNA, 490 bp, Homo sapiens; identical to SEQ ID NO: 535234
  misc_feature: HIJSMM301AU4ET.17.21.B10.1.454.light.4.raw

SEQ ID NO: 549610 - DNA, 489 bp, Homo sapiens
  misc_feature: HIJSMM301AIPBU.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgtaactagtggctgcaccatctgtt

SEQ ID NO: 549611 - DNA, 491 bp, Homo sapiens
  misc_feature: HIJSMM301CI42G.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcggccagggaccacagtggatatcaggcgaactgtggctgcaccatctgtctt

SEQ ID NO: 549612 - DNA, 494 bp, Homo sapiens; identical to SEQ ID NO: 534994
  misc_feature: HIJSMM301CLQR6.27.78.H01.1.454.light.4.raw

SEQ ID NO: 549613 - DNA, 490 bp, Homo sapiens; identical to SEQ ID NO: 543909
  misc_feature: HIJSMM301BGYZM.14.55.E11.1.454.light.4.raw

SEQ ID NO: 549614 - DNA, 507 bp, Homo sapiens
  misc_feature: HIJSMM301C9LEQ.47.55.E11.1.454.light.4.raw
agctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcggagctgggaccaaggtcaccgtcctaggtcagcccaaggcccaacccactgtca

SEQ ID NO: 549615 - DNA, 495 bp, Homo sapiens; identical to SEQ ID NO: 535821
  misc_feature: HIJSMM301C4M25.3.31.C09.1.454.light.4.raw

SEQ ID NO: 549616 - DNA, 492 bp, Homo sapiens
  misc_feature: HIJSMM301BNZNN.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggccaagctggagatcaatcgaactgtggc

SEQ ID NO: 549617 - DNA, 496 bp, Homo sapiens; identical to SEQ ID NO: 535109
  misc_feature: HIJSMM301ADUF3.16.78.H01.1.454.light.4.raw

SEQ ID NO: 549618 - DNA, 501 bp, Homo sapiens
  misc_feature: HIJSMM301BYNWY.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtctttcatctttccccg

SEQ ID NO: 549619 - DNA, 486 bp, Homo sapiens; identical to SEQ ID NO: 537617
  misc_feature: HIJSMM301CFWOL.10.53.E09.1.454.light.4.raw

SEQ ID NO: 549620 - DNA, 485 bp, Homo sapiens; identical to SEQ ID NO: 536040
  misc_feature: HIJSMM301ELC9K.15.1.A01.1.454.light.4.raw

SEQ ID NO: 549621 - DNA, 495 bp, Homo sapiens
  misc_feature: HIJSMM301CDBPH.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatggtgccgataccgagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccacggggaccgaccggtggagtgtcaagcgaactgtggctgcaccatcttcg

SEQ ID NO: 549622 - DNA, 498 bp, Homo sapiens
  misc_feature: HIJSMM301BIDPZ.49.73.G07.1.454.light.4.raw
agtcgagagacacgaccggtgctcgatttagctctacgctcagggcacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgctagtttattactgtcaacagcgtaccacaggattcactttcggccctgggaccagagtggatatcaaacgaa

SEQ ID NO: 549623 - DNA, 441 bp, Homo sapiens; identical to SEQ ID NO: 534971
  misc_feature: HIJSMM301EUGJS.11.3.A03.1.454.light.4.raw

SEQ ID NO: 549624 - DNA, 481 bp, Homo sapiens
  misc_feature: HIJSMM301EJ086.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttggccaggggaccaaggtcgaaatgagacgaactgtggctgcaccat

SEQ ID NO: 549625 - DNA, 485 bp, Homo sapiens; identical to SEQ ID NO: 535880
  misc_feature: HIJSMM301AT8HU.7.75.G09.1.454.light.4.raw

SEQ ID NO: 549626 - DNA, 454 bp, Homo sapiens
  misc_feature: HIJSMM301CQ0YD.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcattctgttcccgccctcctccacgagagta

SEQ ID NO: 549627 - DNA, 485 bp, Homo sapiens
  misc_feature: HIJSMM301D649W.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggccgagggaccagggtggaaatacaaacgaacctgtggctgcacca

SEQ ID NO: 549628 - DNA, 479 bp, Homo sapiens; identical to SEQ ID NO: 538892
  misc_feature: HIJSMM301BEEYM.22.59.F04.1.454.light.4.raw

SEQ ID NO: 549629 - DNA, 447 bp, Homo sapiens; identical to SEQ ID NO: 535201
  misc_feature: HIJSMM301ETDXP.18.9.A09.1.454.light.4.raw

SEQ ID NO: 549630 - DNA, 502 bp, Homo sapiens; identical to SEQ ID NO: 544444
  misc_feature: HIJSMM301BRY1I.5.24.C02.1.454.light.4.raw

SEQ ID NO: 549631 - DNA, 489 bp, Homo sapiens
  misc_feature: HIJSMM301AWVH9.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccaaggctgccccctcggtcactc

SEQ ID NO: 549632 - DNA, 383 bp, Homo sapiens; identical to SEQ ID NO: 447524
  misc_feature: HIJSMM301DEPBQ.41.26.C04.1.454.light.4.raw

SEQ ID NO: 549633 - DNA, 484 bp, Homo sapiens
  misc_feature: HIJSMM301A0L9Y.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcgaccaagggacacgactggagattaaacgaactgtggctgcaccat

SEQ ID NO: 549634 - DNA, 483 bp, Homo sapiens
  misc_feature: HIJSMM301CQVZP.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcacttcggcggagggaccagggtggaggatcagacgaa

SEQ ID NO: 549635 - DNA, 305 bp, Homo sapiens; identical to SEQ ID NO: 539887
  misc_feature: HIJSMM301DFZRZ.49.19.B08.1.454.light.4.raw

SEQ ID NO: 549636 - DNA, 476 bp, Homo sapiens
  misc_feature: HIJSMM301AZIZY.41.5.A05.1.454.light.4.raw
tctatactatcacgaccggtgctcgatttagatagatagacaggggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccat

SEQ ID NO: 549637 - DNA, 517 bp, Homo sapiens
  misc_feature: HIJSMM301ANDM6.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccaccccctcctccgactacgtacgtacgtaggcggcgggtcgtcggacgac

SEQ ID NO: 549638 - DNA, 485 bp, Homo sapiens
  misc_feature: HIJSMM301C18QT.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 549639 - DNA, 495 bp, Homo sapiens
  misc_feature: HIJSMM301CE608.10.49.E05.1.454.light.4.raw
catagtagtgcacgaccggtgctcgatttagagcgactagcaacacacaaagggggaggaactgctcagttaggacccagagggaaccatggaagccccagctcagcttctcttcctcctgctactctggctcccagatgccaccggagcagttgtattgacacagtctccagccaccctgtctttgtctccaggggaaagagccaccctctcctgcagggccagtcagagcgttagcaactacttagcctggtaccaacagaaacctggccaggctcccaggctcctcatctatgatgtatccagccgggccactggcgtcccagccaggttcagtggcagtgggtctgggacagacttcactctcaccatcagcagcctagagcctgaagattttgcggtttattactgtcagcagcgtggccactggcctgcgttccctttcggccctgggaccaaagtggatatcaaacgaactgtggctgcaccatctgt

SEQ ID NO: 549640 - DNA, 488 bp, Homo sapiens; identical to SEQ ID NO: 542699
  misc_feature: HIJSMM301DZ17D.12.51.E07.1.454.light.4.raw

SEQ ID NO: 549641 - DNA, 501 bp, Homo sapiens; identical to SEQ ID NO: 537545
  misc_feature: HIJSMM301D88LJ.49.69.G03.1.454.light.4.raw

SEQ ID NO: 549642 - DNA, 489 bp, Homo sapiens
  misc_feature: HIJSMM301AG3Y4.52.70.G04.1.454.light.4.raw
cgcagtacgacacgaccggtgctcgatttagtgtagtgtgaagggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccgcagactggagcctgaagattttgcggtgtattattgtcagcactatgatacctcactcatgtacacttttggccaggggaccaagctggagatcaaacgaactgtggctgcacc

SEQ ID NO: 549643 - DNA, 521 bp, Homo sapiens
  misc_feature: HIJSMM301BOVSK.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcact

SEQ ID NO: 549644 - DNA, 460 bp, Homo sapiens; identical to SEQ ID NO: 536053
  misc_feature: HIJSMM301BHFOI.22.28.C06.1.454.light.4.raw

SEQ ID NO: 549645 - DNA, 488 bp, Homo sapiens
  misc_feature: HIJSMM301AN4DH.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcagcccc

SEQ ID NO: 549646 - DNA, 511 bp, Homo sapiens
  misc_feature: HIJSMM301BKUOL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtaggaaagtacaaacgaactagtggctgcaccactctgtcttctactcttccccg

SEQ ID NO: 549647 - DNA, 504 bp, Homo sapiens; identical to SEQ ID NO: 542968
  misc_feature: HIJSMM301DP3K8.11.57.F02.1.454.light.4.raw

SEQ ID NO: 549648 - DNA, 484 bp, Homo sapiens
  misc_feature: HIJSMM301EBZF9.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 549649 - DNA, 487 bp, Homo sapiens
  misc_feature: HIJSMM301ELZH1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaa

SEQ ID NO: 549650 - DNA, 486 bp, Homo sapiens
  misc_feature: HIJSMM301EMT9P.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggccacgtcccaagaacttttggccaggggaccaagctggagatcaaacgaactgtggctgcaccat

SEQ ID NO: 549651 - DNA, 488 bp, Homo sapiens; identical to SEQ ID NO: 542699
  misc_feature: HIJSMM301CVGS2.12.51.E07.1.454.light.4.raw

SEQ ID NO: 549652 - DNA, 486 bp, Homo sapiens; identical to SEQ ID NO: 537127
  misc_feature: HIJSMM301AIZUH.3.77.G11.1.454.light.4.raw

SEQ ID NO: 549653 - DNA, 494 bp, Homo sapiens
  misc_feature: HIJSMM301B4AM0.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactt

SEQ ID NO: 549654 - DNA, 502 bp, Homo sapiens
  misc_feature: HIJSMM301BCN5D.9.53.E09.1.454.light.4.raw
tgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccaccctcctcagacgtatca

SEQ ID NO: 549655 - DNA, 503 bp, Homo sapiens
  misc_feature: HIJSMM301AL01Y.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 549656 - DNA, 496 bp, Homo sapiens; identical to SEQ ID NO: 535423
  misc_feature: HIJSMM301BSWT5.3.33.C11.1.454.light.4.raw

SEQ ID NO: 549657 - DNA, 489 bp, Homo sapiens; identical to SEQ ID NO: 536663
  misc_feature: HIJSMM301DAHAB.16.72.G06.1.454.light.4.raw

SEQ ID NO: 549658 - DNA, 491 bp, Homo sapiens
  misc_feature: HIJSMM301DUSV3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgtagtctattactgtcagcagtatggtcacgtcccaagaacttttggccaggggaccaagctggagatcaaacgaactgtggctgcaccatctgtt

SEQ ID NO: 549659 - DNA, 444 bp, Homo sapiens; identical to SEQ ID NO: 535594
  misc_feature: HIJSMM301BIRV8.9.9.A09.1.454.light.4.raw

SEQ ID NO: 549660 - DNA, 415 bp, Homo sapiens
  misc_feature: HIJSMM301CEO3B.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccaccctcctcgagtagtaca

SEQ ID NO: 549661 - DNA, 484 bp, Homo sapiens; identical to SEQ ID NO: 535400
  misc_feature: HIJSMM301D3AY4.46.26.C04.1.454.light.4.raw

SEQ ID NO: 549662 - DNA, 488 bp, Homo sapiens
  misc_feature: HIJSMM301EU8AN.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggacgaacggtaggaggatcaaacgaaactagtggcgtgcacca

SEQ ID NO: 549663 - DNA, 454 bp, Homo sapiens; identical to SEQ ID NO: 535005
  misc_feature: HIJSMM301AUBH2.19.86.H09.1.454.light.4.raw

SEQ ID NO: 549664 - DNA, 495 bp, Homo sapiens; identical to SEQ ID NO: 543094
  misc_feature: HIJSMM301DUXSL.22.57.F02.1.454.light.4.raw

SEQ ID NO: 549665 - DNA, 493 bp, Homo sapiens; identical to SEQ ID NO: 535745
  misc_feature: HIJSMM301BXFWO.47.78.H01.1.454.light.4.raw

SEQ ID NO: 549666 - DNA, 497 bp, Homo sapiens; identical to SEQ ID NO: 538296
  misc_feature: HIJSMM301ED8OS.18.11.A11.1.454.light.4.raw

SEQ ID NO: 549667 - DNA, 454 bp, Homo sapiens; identical to SEQ ID NO: 534964
  misc_feature: HIJSMM301AQFXH.19.86.H09.1.454.light.4.raw

SEQ ID NO: 549668 - DNA, 497 bp, Homo sapiens
  misc_feature: HIJSMM301BZW6W.8.2.A02.1.454.light.4.raw
ctcgcgtgtccacgaccggtgctcgatttagactcatctacaggggaggaactgctcagttaggacccagagggaaccatggaagcgccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgcc

SEQ ID NO: 549669 - DNA, 493 bp, Homo sapiens
  misc_feature: HIJSMM301C0KET.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattcactttcggccctgggaccaaagtggatttcagacgaactgtggctgcaccatctgtcttcta

SEQ ID NO: 549670 - DNA, 454 bp, Homo sapiens
  misc_feature: HIJSMM301BU3HO.13.23.C01.1.454.light.4.raw
tcacgtactacacgaccggtgctcgatttagtacacgtgattagggattgggaggtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaacgatgaatctgattattactgtgttctttatatgggtagtgccatttctgctgtgttcggaggaggcacccgactgaccgtcctcggtcagcccaaggctgccccatcggtcactctgttcccaccctcctctagtacgtga

SEQ ID NO: 549671 - DNA, 505 bp, Homo sapiens
  misc_feature: HIJSMM301BQIBK.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggggaccaaggtggagatcagacgaactgtggctgcaccatctgtcttcatcttccccg

SEQ ID NO: 549672 - DNA, 444 bp, Homo sapiens; identical to SEQ ID NO: 535027
  misc_feature: HIJSMM301DRUOC.8.73.G07.1.454.light.4.raw

SEQ ID NO: 549673 - DNA, 497 bp, Homo sapiens; identical to SEQ ID NO: 536807
  misc_feature: HIJSMM301EQUBA.10.37.D04.1.454.light.4.raw

SEQ ID NO: 549674 - DNA, 494 bp, Homo sapiens; identical to SEQ ID NO: 534994
  misc_feature: HIJSMM301DEWVK.27.78.H01.1.454.light.4.raw

SEQ ID NO: 549675 - DNA, 447 bp, Homo sapiens; identical to SEQ ID NO: 535201
  misc_feature: HIJSMM301B52NH.18.9.A09.1.454.light.4.raw

SEQ ID NO: 549676 - DNA, 491 bp, Homo sapiens
  misc_feature: HIJSMM301E1E1Z.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggtttattcactttcggccctgggaccaaagtggatttcagacgaactgtggctgcaccatctgtcttcta

SEQ ID NO: 549677 - DNA, 520 bp, Homo sapiens; identical to SEQ ID NO: 539176
  misc_feature: HIJSMM301D6BTX.27.23.C01.1.454.light.4.raw

SEQ ID NO: 549678 - DNA, 496 bp, Homo sapiens
  misc_feature: HIJSMM301AVB3W.48.23.C01.1.454.light.4.raw
agtatacatacacgaccggtgctcgatttagtacacgtgattagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 549679 - DNA, 496 bp, Homo sapiens; identical to SEQ ID NO: 542070
  misc_feature: HIJSMM301D0J8W.22.14.B03.1.454.light.4.raw

SEQ ID NO: 549680 - DNA, 511 bp, Homo sapiens; identical to SEQ ID NO: 546571
  misc_feature: HIJSMM301CQ2E3.17.33.C11.1.454.light.4.raw

SEQ ID NO: 549681 - DNA, 511 bp, Homo sapiens; identical to SEQ ID NO: 546571
  misc_feature: HIJSMM301CDBUQ.17.33.C11.1.454.light.4.raw

SEQ ID NO: 549682 - DNA, 493 bp, Homo sapiens; identical to SEQ ID NO: 544835
  misc_feature: HIJSMM301BD9CA.43.29.C07.1.454.light.4.raw

SEQ ID NO: 549683 - DNA, 495 bp, Homo sapiens
  misc_feature: HIJSMM301A7B4C.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaagctgcccctcggtcactctcg

SEQ ID NO: 549684 - DNA, 491 bp, Homo sapiens
  misc_feature: HIJSMM301EPVKE.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggagatcagacgaactagtggctgcaccatctgtcttcta

SEQ ID NO: 549685 - DNA, 494 bp, Homo sapiens
  misc_feature: HIJSMM301CZHNP.52.55.E11.1.454.light.4.raw
cgcagtacgacacgaccggtgctcgatttagcactcgcacgttgggtttgggggaactgctcagttaggacccagagggaaccatggaagccccagctcagcttctcttcctcctgctactctggctcccagataccaccggagaagttgtattgacacagtctccagccaccctgtctttgtctccagggggagagccaccctctcctgcagggccagtcagagtgttgacaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccg

SEQ ID NO: 549686 - DNA, 481 bp, Homo sapiens
  misc_feature: HIJSMM301CPBIW.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctggacgttcggccaagggaccaaggtggaaatcaaacgaactagtggctgcaccta

SEQ ID NO: 549687 - DNA, 483 bp, Homo sapiens
  misc_feature: HIJSMM301COSJ5.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgattcacttttggtccaggggaccaggctggagatcagacgaactgt

SEQ ID NO: 549688 - DNA, 504 bp, Homo sapiens
  misc_feature: HIJSMM301DBA1B.8.21.B10.1.454.light.4.raw
ctcgcgtgtccacgaccggtgctcgatttagtgtcgtcgcaggagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 549689 - DNA, 529 bp, Homo sapiens
  misc_feature: HIJSMM301BAMI3.43.81.H04.1.454.light.4.raw
tgtgagtagtcacgaccggtgctcgatttagtagtgtagattcgcggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgtaccgtcctacggtcgagcccaacggcgtcgcccccgtccggtcactcctgttcccacccctccctcaccta

SEQ ID NO: 549690 - DNA, 489 bp, Homo sapiens; identical to SEQ ID NO: 535139
  misc_feature: HIJSMM301BPNYL.14.55.E11.1.454.light.4.raw

SEQ ID NO: 549691 - DNA, 515 bp, Homo sapiens
  misc_feature: HIJSMM301AK2CQ.10.26.C04.1.454.light.4.raw
  modified_base (418)..(418): a, c, t, g, unknown or other
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactacngtcagcagtatgttacgtcccccgtggagttcgccaagggaccaggtggcaatcaaccgaactgtggctgcaccatctgtcttcatcttcccgccca

SEQ ID NO: 549692 - DNA, 506 bp, Homo sapiens; identical to SEQ ID NO: 546824
  misc_feature: HIJSMM301AFVB8.8.33.C11.1.454.light.4.raw

SEQ ID NO: 549693 - DNA, 486 bp, Homo sapiens; identical to SEQ ID NO: 535043
  misc_feature: HIJSMM301AOEQS.46.35.D02.1.454.light.4.raw

SEQ ID NO: 549694 - DNA, 518 bp, Homo sapiens; identical to SEQ ID NO: 536231
  misc_feature: HIJSMM301BK908.22.30.C08.1.454.light.4.raw

SEQ ID NO: 549695 - DNA, 472 bp, Homo sapiens; identical to SEQ ID NO: 535898
  misc_feature: HIJSMM301EBUOJ.15.8.A08.1.454.light.4.raw

SEQ ID NO: 549696 - DNA, 510 bp, Homo sapiens
  misc_feature: HIJSMM301EWG7J.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccgaacggtaggaagtacaacgacgaactagtggcgtgcaccaactctgtcttctatcttcccgt

SEQ ID NO: 549697 - DNA, 494 bp, Homo sapiens
  misc_feature: HIJSMM301APFF2.43.82.H05.1.454.light.4.raw
tgtgagtagtcacgaccggtgctcgatttagtcgagctctctcgcggggcagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccc

SEQ ID NO: 549698 - DNA, 448 bp, Homo sapiens; identical to SEQ ID NO: 536036
  misc_feature: HIJSMM301AGXPU.18.9.A09.1.454.light.4.raw

SEQ ID NO: 549699 - DNA, 513 bp, Homo sapiens
  misc_feature: HIJSMM301BFDHP.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccca

SEQ ID NO: 549700 - DNA, 495 bp, Homo sapiens
  misc_feature: HIJSMM301CXXL1.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacaggacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttccgcc

SEQ ID NO: 549701 - DNA, 496 bp, Homo sapiens; identical to SEQ ID NO: 535109
  misc_feature: HIJSMM301CG3Q4.16.78.H01.1.454.light.4.raw

SEQ ID NO: 549702 - DNA, 484 bp, Homo sapiens; identical to SEQ ID NO: 535400
  misc_feature: HIJSMM301C169C.46.26.C04.1.454.light.4.raw

SEQ ID NO: 549703 - DNA, 472 bp, Homo sapiens
  misc_feature: HIJSMM301BAHK3.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctggccgattccgtggcagtggatctgggacaaatttcactctcaccatcaatagcctgcaggctgaagatgtggcagcttattattgtcagcaatattatacttctcttccgatcacttttggccaggggaccaggctggagat

SEQ ID NO: 549704 - DNA, 509 bp, Homo sapiens
  misc_feature: HIJSMM301BDBZ3.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtacggaagtacaagacgaactagtggtcgtgcgaccactctgtcttctatt

SEQ ID NO: 549705 - DNA, 493 bp, Homo sapiens; identical to SEQ ID NO: 536471
  misc_feature: HIJSMM301DVRN6.3.71.G05.1.454.light.4.raw

SEQ ID NO: 549706 - DNA, 486 bp, Homo sapiens; identical to SEQ ID NO: 535043
  misc_feature: HIJSMM301BW1M3.46.35.D02.1.454.light.4.raw

SEQ ID NO: 549707 - DNA, 491 bp, Homo sapiens; identical to SEQ ID NO: 542310
  misc_feature: HIJSMM301B1NL3.22.65.F10.1.454.light.4.raw

SEQ ID NO: 549708 - DNA, 454 bp, Homo sapiens; identical to SEQ ID NO: 536325
  misc_feature: HIJSMM301CT76E.19.86.H09.1.454.light.4.raw
  modified_base (436)..(436): a, c, t, g, unknown or other

SEQ ID NO: 549709 - DNA, 489 bp, Homo sapiens; identical to SEQ ID NO: 539323
  misc_feature: HIJSMM301CDBQC.49.46.E02.1.454.light.4.raw

SEQ ID NO: 549710 - DNA, 515 bp, Homo sapiens
  misc_feature: HIJSMM301E2WQ4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaaccgaaggtaggaaagtacaaacgaaactagtaggcgtggcaccaatctgtcttcatcttccccg

SEQ ID NO: 549711 - DNA, 499 bp, Homo sapiens
  misc_feature: HIJSMM301AE8BP.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactagtggctgcaccat

SEQ ID NO: 549712 - DNA, 503 bp, Homo sapiens
  misc_feature: HIJSMM301AQOQY.27.78.H01.1.454.light.4.raw
  modified_base (412)..(412): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttactcaagtgatcacccttcggccaagggacacgactggagattaaacg

SEQ ID NO: 549713 - DNA, 489 bp, Homo sapiens; identical to SEQ ID NO: 535139
  misc_feature: HIJSMM301A4CO4.14.55.E11.1.454.light.4.raw

SEQ ID NO: 549714 - DNA, 484 bp, Homo sapiens; identical to SEQ ID NO: 540489
  misc_feature: HIJSMM301C3JFJ.7.75.G09.1.454.light.4.raw

SEQ ID NO: 549715 - DNA, 497 bp, Homo sapiens; identical to SEQ ID NO: 535692
  misc_feature: HIJSMM301A2XLA.7.59.F04.1.454.light.4.raw

SEQ ID NO: 549716 - DNA, 462 bp, Homo sapiens
  misc_feature: HIJSMM301AWDGL.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaacgaa

SEQ ID NO: 549717 - DNA, 422 bp, Homo sapiens; identical to SEQ ID NO: 447881
  misc_feature: HIJSMM301EC0YK.9.34.D01.1.454.light.4.raw

SEQ ID NO: 549718 - DNA, 496 bp, Homo sapiens
  misc_feature: HIJSMM301CG7VR.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgcaa

SEQ ID NO: 549719 - DNA, 513 bp, Homo sapiens; identical to SEQ ID NO: 535244
  misc_feature: HIJSMM301DGE22.17.33.C11.1.454.light.4.raw

SEQ ID NO: 549720 - DNA, 503 bp, Homo sapiens; identical to SEQ ID NO: 536760
  misc_feature: HIJSMM301C06QO.47.55.E11.1.454.light.4.raw

SEQ ID NO: 549721 - DNA, 490 bp, Homo sapiens
  misc_feature: HIJSMM301B7WOW.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagccc

SEQ ID NO: 549722 - DNA, 486 bp, Homo sapiens; identical to SEQ ID NO: 535043
  misc_feature: HIJSMM301CODHR.46.35.D02.1.454.light.4.raw

SEQ ID NO: 549723 - DNA, 444 bp, Homo sapiens; identical to SEQ ID NO: 544240
  misc_feature: HIJSMM301CWE3U.9.9.A09.1.454.light.4.raw
  modified_base (426)..(426): a, c, t, g, unknown or other

SEQ ID NO: 549724 - DNA, 485 bp, Homo sapiens; identical to SEQ ID NO: 535609
  misc_feature: HIJSMM301DXWQQ.46.35.D02.1.454.light.4.raw

SEQ ID NO: 549725 - DNA, 507 bp, Homo sapiens
  misc_feature: HIJSMM301AZAME.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 549726 - DNA, 482 bp, Homo sapiens
  misc_feature: HIJSMM301A9Z85.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgatcgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 549727 - DNA, 487 bp, Homo sapiens
  misc_feature: HIJSMM301DWRJI.49.38.D05.1.454.light.4.raw
agtcgagagacacgaccggtgctcgatttagtatctgatagttgggtttgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggcctaggggaccaagctggagatcaaacgaactgtggctgcaccatct

SEQ ID NO: 549728 - DNA, 421 bp, Homo sapiens
  misc_feature: HIJSMM301DZ98U.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcctcagacgtatta

SEQ ID NO: 549729 - DNA, 495 bp, Homo sapiens; identical to SEQ ID NO: 535596
  misc_feature: HIJSMM301EIVKZ.10.79.H02.1.454.light.4.raw

SEQ ID NO: 549730 - DNA, 505 bp, Homo sapiens
  misc_feature: HIJSMM301CPZ7S.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaacttgggaccgaggtcaccgtcctaggtcagcccaaggccaaccccactgtcta

SEQ ID NO: 549731 - DNA, 487 bp, Homo sapiens
  misc_feature: HIJSMM301D3LSK.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgcccccg

SEQ ID NO: 549732 - DNA, 497 bp, Homo sapiens
  misc_feature: HIJSMM301D9Q2H.48.33.C11.1.454.light.4.raw
agtatacatacacgaccggtgctcgatttagagtgagctcgttgggtttggggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 549733 - DNA, 487 bp, Homo sapiens; identical to SEQ ID NO: 537009
  misc_feature: HIJSMM301AJGYX.12.88.H11.1.454.light.4.raw

SEQ ID NO: 549734 - DNA, 484 bp, Homo sapiens
  misc_feature: HIJSMM301B9EN6.49.60.F05.1.454.light.4.raw
agtcgagagacacgaccggtgctcgatttagtacgtcatcagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacgaa

SEQ ID NO: 549735 - DNA, 443 bp, Homo sapiens; identical to SEQ ID NO: 544936
  misc_feature: HIJSMM301AML6C.2.76.G10.1.454.light.4.raw

SEQ ID NO: 549736 - DNA, 484 bp, Homo sapiens; identical to SEQ ID NO: 535400
  misc_feature: HIJSMM301BPALN.46.26.C04.1.454.light.4.raw

SEQ ID NO: 549737 - DNA, 484 bp, Homo sapiens; identical to SEQ ID NO: 535240
  misc_feature: HIJSMM301DNUJK.47.60.F05.1.454.light.4.raw

SEQ ID NO: 549738 - DNA, 490 bp, Homo sapiens
  misc_feature: HIJSMM301ERHO5.10.59.F04.1.454.light.4.raw
catagtagtgcacgaccggtgctcgatttagtacacacacttagggattggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggaggacccaagctgaccgtcctaggtcagccccg

SEQ ID NO: 549739 - DNA, 487 bp, Homo sapiens; identical to SEQ ID NO: 536206
  misc_feature: HIJSMM301BNXLC.47.38.D05.1.454.light.4.raw

SEQ ID NO: 549740 - DNA, 509 bp, Homo sapiens; identical to SEQ ID NO: 539359
  misc_feature: HIJSMM301B6B28.47.85.H08.1.454.light.4.raw

SEQ ID NO: 549741 - DNA, 483 bp, Homo sapiens; identical to SEQ ID NO: 539848
  misc_feature: HIJSMM301EM0CI.46.26.C04.1.454.light.4.raw

SEQ ID NO: 549742 - DNA, 474 bp, Homo sapiens; identical to SEQ ID NO: 537034
  misc_feature: HIJSMM301DQLZC.5.15.B04.1.454.light.4.raw

SEQ ID NO: 549743 - DNA, 490 bp, Homo sapiens; identical to SEQ ID NO: 541141
  misc_feature: HIJSMM301DEODB.47.38.D05.1.454.light.4.raw

SEQ ID NO: 549744 - DNA, 454 bp, Homo sapiens
  misc_feature: HIJSMM301BXAAN.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctcgacgttcgcaggacagtgaa

SEQ ID NO: 549745 - DNA, 486 bp, Homo sapiens
  misc_feature: HIJSMM301BA97T.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtggctgcaccatctgtt

SEQ ID NO: 549746 - DNA, 494 bp, Homo sapiens
  misc_feature: HIJSMM301CVRR6.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattcactttcggccctgggaccaaagtggatttcagacgaactgtggctgcaccatctgttcttcta

SEQ ID NO: 549747 - DNA, 469 bp, Homo sapiens; identical to SEQ ID NO: 536091
  misc_feature: HIJSMM301BNPFU.3.82.H05.1.454.light.4.raw

SEQ ID NO: 549748 - DNA, 465 bp, Homo sapiens
  misc_feature: HIJSMM301DCKGA.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaa

SEQ ID NO: 549749 - DNA, 478 bp, Homo sapiens
  misc_feature: HIJSMM301AOWOT.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgcaactttactactgtcaacagtagttttcagtatcccttggactttcggccaagggaccaaggtaggaaatacaaacgaa

SEQ ID NO: 549750 - DNA, 481 bp, Homo sapiens; identical to SEQ ID NO: 537385
  misc_feature: HIJSMM301A3Z6O.52.4.A04.1.454.light.4.raw

SEQ ID NO: 549751 - DNA, 482 bp, Homo sapiens; identical to SEQ ID NO: 535352
  misc_feature: HIJSMM301BSCQS.16.81.H04.1.454.light.4.raw

SEQ ID NO: 549752 - DNA, 492 bp, Homo sapiens
  misc_feature: HIJSMM301AL9AE.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgtttttcggccaagggacacgactacaaattaaacgaactgtggctgcaccatctgtcttcatcttcccgccat

SEQ ID NO: 549753 - DNA, 505 bp, Homo sapiens
  misc_feature: HIJSMM301CVI7H.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctgcccctcggtcact

SEQ ID NO: 549754 - DNA, 485 bp, Homo sapiens
  misc_feature: HIJSMM301BDZLO.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaaggtggaaatcaaacgaactagttggctgcacca

SEQ ID NO: 549755 - DNA, 498 bp, Homo sapiens
  misc_feature: HIJSMM301A532J.11.60.F05.1.454.light.4.raw
cgagagataccacgaccggtgctcgatttagtacgtcatcagggaaagggggaggaactgctcagttaggacccagacggaaccatggaagccccagcgcagcttctcttcctcctgctactctggctcccagataccactggagaaattgtgatgacgcagtctccagccaccctgtctgtgtctccaggggaaagagccaccctctcctgcagggccagtcagagtattagcagcaacttagcctggtaccaacaaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccaagggaccaaggtggaaatcaaacgaactagtggctgcaccatctgtctt

SEQ ID NO: 549756 - DNA, 497 bp, Homo sapiens
  misc_feature: HIJSMM301BUUUG.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctcg

SEQ ID NO: 549757 - DNA, 512 bp, Homo sapiens
  misc_feature: HIJSMM301DQ120.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttccc

SEQ ID NO: 549758 - DNA, 349 bp, Homo sapiens
  misc_feature: HIJSMM301ARQWD.3.9.A09.1.454.light.4.raw
agacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtattactgtcatcagtataataactctccgctcactttcggcggagggaccaaagtggagctcagacgaactgtggctgcaccatctgtcttcatcttcccgccatctgagagtgcgtct

SEQ ID NO: 549759 - DNA, 460 bp, Homo sapiens; identical to SEQ ID NO: 539553
  misc_feature: HIJSMM301DFHJL.11.86.H09.1.454.light.4.raw

SEQ ID NO: 549760 - DNA, 485 bp, Homo sapiens; identical to SEQ ID NO: 538533
  misc_feature: HIJSMM301EPFG5.47.78.H01.1.454.light.4.raw

SEQ ID NO: 549761 - DNA, 503 bp, Homo sapiens; identical to SEQ ID NO: 538884
  misc_feature: HIJSMM301AOILW.27.78.H01.1.454.light.4.raw

SEQ ID NO: 549762 - DNA, 484 bp, Homo sapiens; identical to SEQ ID NO: 535400
  misc_feature: HIJSMM301AWESE.46.26.C04.1.454.light.4.raw

SEQ ID NO: 549763 - DNA, 503 bp, Homo sapiens
  misc_feature: HIJSMM301CZUUG.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggcttttggcggcgggacccagatgactgtcctcagtcagcccaaggctgccccctc

SEQ ID NO: 549764 - DNA, 511 bp, Homo sapiens
  misc_feature: HIJSMM301CSUNO.7.34.D01.1.454.light.4.raw
  modified_base (503)..(503): a, c, t, g, unknown or other
  modified_base (508)..(508): a, c, t, g, unknown or other
cgtgtctctacacgaccggtgctcgatttagatcgtctgtgttgggtttgggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgcccccncggtnact

SEQ ID NO: 549765 - DNA, 502 bp, Homo sapiens; identical to SEQ ID NO: 541971
  misc_feature: HIJSMM301AD3T4.4.39.D06.1.454.light.4.raw

SEQ ID NO: 549766 - DNA, 506 bp, Homo sapiens
  misc_feature: HIJSMM301CNDQ4.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtctttcggaactgggaccgaggtcaccgtcctaggtcagcccaaggccaacccccactgtcta

SEQ ID NO: 549767 - DNA, 488 bp, Homo sapiens
  misc_feature: HIJSMM301B8RHK.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattctggtcaatctcattctttcggcggagggaccaaggtggagatcagacgaactgtggctgcaccatctgtcttcatcttcccg

SEQ ID NO: 549768 - DNA, 494 bp, Homo sapiens; identical to SEQ ID NO: 534992
  misc_feature: HIJSMM301ER9WF.9.1.A01.1.454.light.4.raw

SEQ ID NO: 549769 - DNA, 509 bp, Homo sapiens
  misc_feature: HIJSMM301CLJEN.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggagggccaaggtggagatcaagcgaactgtggctgcaccatctgtcttcatcttcccg

SEQ ID NO: 549770 - DNA, 499 bp, Homo sapiens
  misc_feature: HIJSMM301EAK6T.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcgaccaagggaccaaggtggaaatcaaacgaactgtggctgcacca

SEQ ID NO: 549771 - DNA, 497 bp, Homo sapiens; identical to SEQ ID NO: 535740
  misc_feature: HIJSMM301CRIWM.3.71.G05.1.454.light.4.raw

SEQ ID NO: 549772 - DNA, 506 bp, Homo sapiens
  misc_feature: HIJSMM301A2D0I.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggaggaccaggctgaccgtcctaagtcagcccaaggctgccccc

SEQ ID NO: 549773 - DNA, 484 bp, Homo sapiens; identical to SEQ ID NO: 535400
  misc_feature: HIJSMM301AFR1V.46.26.C04.1.454.light.4.raw

SEQ ID NO: 549774 - DNA, 489 bp, Homo sapiens
  misc_feature: HIJSMM301AW0FS.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaaggtggaactcaaacgaaa

SEQ ID NO: 549775 - DNA, 444 bp, Homo sapiens; identical to SEQ ID NO: 535411
  misc_feature: HIJSMM301BGK6I.8.73.G07.1.454.light.4.raw

SEQ ID NO: 549776 - DNA, 481 bp, Homo sapiens
  misc_feature: HIJSMM301DQXZO.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaaa

SEQ ID NO: 549777 - DNA, 495 bp, Homo sapiens
  misc_feature: HIJSMM301C9H75.51.35.D02.1.454.light.4.raw
cgatcgtatacacgaccggtgctcgatttagcacacgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 549778 - DNA, 509 bp, Homo sapiens
  misc_feature: HIJSMM301AQP1Q.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccg

SEQ ID NO: 549779 - DNA, 512 bp, Homo sapiens
  misc_feature: HIJSMM301DZ99A.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgcccctcggtcact

SEQ ID NO: 549780 - DNA, 484 bp, Homo sapiens; identical to SEQ ID NO: 537073
  misc_feature: HIJSMM301A96D5.4.57.F02.1.454.light.4.raw

SEQ ID NO: 549781 - DNA, 463 bp, Homo sapiens; identical to SEQ ID NO: 535062
  misc_feature: HIJSMM301DM3ZZ.11.73.G07.1.454.light.4.raw

SEQ ID NO: 549782 - DNA, 490 bp, Homo sapiens
  misc_feature: HIJSMM301EON9F.49.80.H03.1.454.light.4.raw
agtcgagagacacgaccggtgctcgatttagctgtgcgtcgaaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccgccct

SEQ ID NO: 549783 - DNA, 524 bp, Homo sapiens
  misc_feature: HIJSMM301AZ8K4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccgaacgggaccgaacggtaggaaggtacgaaacgaaaccgtagtggcgtgcgaccactctgtcttctatcttcccgtcccact

SEQ ID NO: 549784 - DNA, 502 bp, Homo sapiens; identical to SEQ ID NO: 536253
  misc_feature: HIJSMM301C7E9N.21.22.B11.1.454.light.4.raw

SEQ ID NO: 549785 - DNA, 495 bp, Homo sapiens
  misc_feature: HIJSMM301BXHGV.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttcatt

SEQ ID NO: 549786 - DNA, 500 bp, Homo sapiens
  misc_feature: HIJSMM301COP3V.14.23.C01.1.454.light.4.raw
cgtctagtaccacgaccggtgctcgatttagtacacgtgattagggattgggggaggaactgctcaattaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaactagtggctgcaccatctgtcttcta

SEQ ID NO: 549787 - DNA, 484 bp, Homo sapiens; identical to SEQ ID NO: 535400
  misc_feature: HIJSMM301DP33M.46.26.C04.1.454.light.4.raw

SEQ ID NO: 549788 - DNA, 480 bp, Homo sapiens; identical to SEQ ID NO: 535291
  misc_feature: HIJSMM301DS6PW.22.59.F04.1.454.light.4.raw

SEQ ID NO: 549789 - DNA, 444 bp, Homo sapiens; identical to SEQ ID NO: 535027
  misc_feature: HIJSMM301B0E19.8.73.G07.1.454.light.4.raw

SEQ ID NO: 549790 - DNA, 494 bp, Homo sapiens; identical to SEQ ID NO: 534994
  misc_feature: HIJSMM301DM7L1.27.78.H01.1.454.light.4.raw

SEQ ID NO: 549791 - DNA, 486 bp, Homo sapiens; identical to SEQ ID NO: 535385
  misc_feature: HIJSMM301ECD19.19.71.G05.1.454.light.4.raw

SEQ ID NO: 549792 - DNA, 494 bp, Homo sapiens
  misc_feature: HIJSMM301DZ3HO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgttcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 549793 - DNA, 488 bp, Homo sapiens
  misc_feature: HIJSMM301CPPWX.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 549794 - DNA, 502 bp, Homo sapiens
  misc_feature: HIJSMM301AVFJW.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtagttcggcggaggggaccaaggctgaccgtcctaggtcagcccaaggctgccccctcggtca

SEQ ID NO: 549795 - DNA, 485 bp, Homo sapiens; identical to SEQ ID NO: 536799
  misc_feature: HIJSMM301DO8Z2.19.71.G05.1.454.light.4.raw

SEQ ID NO: 549796 - DNA, 510 bp, Homo sapiens
  misc_feature: HIJSMM301D6DP5.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgtcccacctcct

SEQ ID NO: 549797 - DNA, 494 bp, Homo sapiens; identical to SEQ ID NO: 534994
  misc_feature: HIJSMM301BXTJC.27.78.H01.1.454.light.4.raw

SEQ ID NO: 549798 - DNA, 507 bp, Homo sapiens
  misc_feature: HIJSMM301CLL0C.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 549799 - DNA, 488 bp, Homo sapiens; identical to SEQ ID NO: 541987
  misc_feature: HIJSMM301DOW7S.8.12.B01.1.454.light.4.raw

SEQ ID NO: 549800 - DNA, 505 bp, Homo sapiens; identical to SEQ ID NO: 535503
  misc_feature: HIJSMM301AOSP7.8.28.C06.1.454.light.4.raw

SEQ ID NO: 549801 - DNA, 494 bp, Homo sapiens; identical to SEQ ID NO: 534992
  misc_feature: HIJSMM301CWFS5.9.1.A01.1.454.light.4.raw

SEQ ID NO: 549802 - DNA, 506 bp, Homo sapiens
  misc_feature: HIJSMM301DSC8A.47.83.H06.1.454.light.4.raw
agctcacgtacacgaccggtgctcgatttagatcacgtgcgtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttgggtgttcggcggagggccaagttgaccgtcctaggtcagcccaaggctgccccctcggtcactctgtt

SEQ ID NO: 549803 - DNA, 493 bp, Homo sapiens
  misc_feature: HIJSMM301CC5X9.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagatcagacgaa

SEQ ID NO: 549804 - DNA, 515 bp, Homo sapiens
  misc_feature: HIJSMM301EW8V0.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccgaacgggaccgaacggtaggaaagtacaaacgaactagtggcgtgcaccatctgtcttcatctttccccg

SEQ ID NO: 549805 - DNA, 490 bp, Homo sapiens; identical to SEQ ID NO: 541567
  misc_feature: HIJSMM301BS3ZH.22.65.F10.1.454.light.4.raw

SEQ ID NO: 549806 - DNA, 487 bp, Homo sapiens
  misc_feature: HIJSMM301CRV12.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatacaaacgaactgtggctgcaccat

SEQ ID NO: 549807 - DNA, 476 bp, Homo sapiens
  misc_feature: HIJSMM301A43D7.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctcggactgagtagcatatgaagagaactagtggctgca

SEQ ID NO: 549808 - DNA, 486 bp, Homo sapiens; identical to SEQ ID NO: 535043
  misc_feature: HIJSMM301BVRRG.46.35.D02.1.454.light.4.raw

SEQ ID NO: 549809 - DNA, 495 bp, Homo sapiens; identical to SEQ ID NO: 538651
  misc_feature: HIJSMM301ANYMS.10.79.H02.1.454.light.4.raw

SEQ ID NO: 549810 - DNA, 484 bp, Homo sapiens; identical to SEQ ID NO: 535240
  misc_feature: HIJSMM301BL3EI.47.60.F05.1.454.light.4.raw

SEQ ID NO: 549811 - DNA, 518 bp, Homo sapiens; identical to SEQ ID NO: 539372
  misc_feature: HIJSMM301C6DCQ.7.86.H09.1.454.light.4.raw

SEQ ID NO: 549812 - DNA, 474 bp, Homo sapiens
  misc_feature: HIJSMM301A6VI6.11.76.G10.1.454.light.4.raw
cgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagat

SEQ ID NO: 549813 - DNA, 487 bp, Homo sapiens
  misc_feature: HIJSMM301CCZ5U.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggatcccatcaaggttcagtggcactgggtctgagacagagttcactctcaccatcagcactctacagcctgaagattttgcaacttattattgtcaacaaagttaatgagacccctgccactttcggccctgggaccatagtggatatagaaagaaactgtggctgcacc

SEQ ID NO: 549814 - DNA, 513 bp, Homo sapiens; identical to SEQ ID NO: 539258
  misc_feature: HIJSMM301EED8G.43.19.B08.1.454.light.4.raw

SEQ ID NO: 549815 - DNA, 499 bp, Homo sapiens
  misc_feature: HIJSMM301B3XSG.53.81.H04.1.454.light.4.raw
cgcgtatacacacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctgacacctcagcctccctggccatcagtggcctccggtccgacgatgaggctgattattattgtgcagcatgggatgacagcctgagtggtgtggtattcggcggagggaccaagctgaccgtcctaggtcagcccaaggctcg

SEQ ID NO: 549816 - DNA, 500 bp, Homo sapiens; identical to SEQ ID NO: 548721
  misc_feature: HIJSMM301CDQCW.14.35.D02.1.454.light.4.raw

SEQ ID NO: 549817 - DNA, 492 bp, Homo sapiens; identical to SEQ ID NO: 536733
  misc_feature: HIJSMM301BOZPP.40.11.A11.1.454.light.4.raw

SEQ ID NO: 549818 - DNA, 482 bp, Homo sapiens
  misc_feature: HIJSMM301DF3C2.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaccgaactgtggctgcaccat

SEQ ID NO: 549819 - DNA, 497 bp, Homo sapiens; identical to SEQ ID NO: 536376
  misc_feature: HIJSMM301EEMBB.22.9.A09.1.454.light.4.raw

SEQ ID NO: 549820 - DNA, 505 bp, Homo sapiens
  misc_feature: HIJSMM301CU0V5.8.28.C06.1.454.light.4.raw
ctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggagaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 549821 - DNA, 485 bp, Homo sapiens
  misc_feature: HIJSMM301AZBYX.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtgggtcccatcaagattcagtggcggtggatctgggacagatttcactctcaccatcaacagtctgcagattgaggattatgcaacttattactgtcagcagagttccaggaccccgctcactttcggcggggggaccaaaagtggacgtcaaacgaactgtggctgcacca

SEQ ID NO: 549822 - DNA, 486 bp, Homo sapiens; identical to SEQ ID NO: 535385
  misc_feature: HIJSMM301BFY3I.19.71.G05.1.454.light.4.raw

SEQ ID NO: 549823 - DNA, 504 bp, Homo sapiens
  misc_feature: HIJSMM301CCOCP.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagccaaggctgccccctcggtcactctcg

SEQ ID NO: 549824 - DNA, 447 bp, Homo sapiens; identical to SEQ ID NO: 535201
  misc_feature: HIJSMM301ET8CD.18.9.A09.1.454.light.4.raw

SEQ ID NO: 549825 - DNA, 514 bp, Homo sapiens
  misc_feature: HIJSMM301BDDC6.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttccccg

SEQ ID NO: 549826 - DNA, 486 bp, Homo sapiens; identical to SEQ ID NO: 535385
  misc_feature: HIJSMM301CNZQZ.19.71.G05.1.454.light.4.raw

SEQ ID NO: 549827 - DNA, 491 bp, Homo sapiens
  misc_feature: HIJSMM301BIAMS.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcaagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttacttcggccctgggaccaaagtggatatcaaacgaactgtggctgcaccat

SEQ ID NO: 549828 - DNA, 503 bp, Homo sapiens
  misc_feature: HIJSMM301EJ5O1.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaaatactatagtcctcctctcacgttcgggcggagggaccaaggtggagatcaaacgaactgtggctgcaccatctgtctt

SEQ ID NO: 549829 - DNA, 477 bp, Homo sapiens
  misc_feature: HIJSMM301DZL5L.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactatcaacaatataacagttattggacgttcggccaagggaccaaggtggaaatcaaacgaactgtggctgcacca

SEQ ID NO: 549830 - DNA, 501 bp, Homo sapiens
  misc_feature: HIJSMM301AFFB1.22.21.B10.1.454.light.4.raw
acatacgcgtcacgaccggtgctcgatttagtgtcgtcgcaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 549831 - DNA, 382 bp, Homo sapiens
  misc_feature: HIJSMM301DAUB8.41.53.E09.1.454.light.4.raw
tctatactatcacgaccggtgctcgatttagagagagtgtgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttccgccatctgaatagtataga

SEQ ID NO: 549832 - DNA, 516 bp, Homo sapiens
  misc_feature: HIJSMM301ELS7N.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccacctcctc

SEQ ID NO: 549833 - DNA, 494 bp, Homo sapiens; identical to SEQ ID NO: 540110
  misc_feature: HIJSMM301BAU8O.51.71.G05.1.454.light.4.raw

SEQ ID NO: 549834 - DNA, 493 bp, Homo sapiens; identical to SEQ ID NO: 535745
  misc_feature: HIJSMM301CUC9D.47.78.H01.1.454.light.4.raw

SEQ ID NO: 549835 - DNA, 504 bp, Homo sapiens
  misc_feature: HIJSMM301DKUIG.8.28.C06.1.454.light.4.raw
ctcgcgtgtccacgaccggtgctcgatttagagctcacgtattgggtttgggggaggaactgcacagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgc

SEQ ID NO: 549836 - DNA, 497 bp, Homo sapiens
  misc_feature: HIJSMM301DK41Z.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtccaggtcagcccaaggctgccccctcggt

SEQ ID NO: 549837 - DNA, 511 bp, Homo sapiens
  misc_feature: HIJSMM301BQIHE.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 549838 - DNA, 484 bp, Homo sapiens; identical to SEQ ID NO: 535211
  misc_feature: HIJSMM301BZK9Y.47.46.E02.1.454.light.4.raw

SEQ ID NO: 549839 - DNA, 484 bp, Homo sapiens; identical to SEQ ID NO: 535400
  misc_feature: HIJSMM301DV5L0.46.26.C04.1.454.light.4.raw

SEQ ID NO: 549840 - DNA, 486 bp, Homo sapiens; identical to SEQ ID NO: 535043
  misc_feature: HIJSMM301ECUL3.46.35.D02.1.454.light.4.raw

SEQ ID NO: 549841 - DNA, 444 bp, Homo sapiens
  misc_feature: HIJSMM301C0VMR.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctcgtactagacg

SEQ ID NO: 549842 - DNA, 475 bp, Homo sapiens; identical to SEQ ID NO: 548160
  misc_feature: HIJSMM301D8V06.52.1.A01.1.454.light.4.raw

SEQ ID NO: 549843 - DNA, 482 bp, Homo sapiens
  misc_feature: HIJSMM301D3S7S.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcacca

SEQ ID NO: 549844 - DNA, 499 bp, Homo sapiens
  misc_feature: HIJSMM301CVABO.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtcact

SEQ ID NO: 549845 - DNA, 494 bp, Homo sapiens; identical to SEQ ID NO: 536463
  misc_feature: HIJSMM301BZMN4.22.57.F02.1.454.light.4.raw

SEQ ID NO: 549846 - DNA, 494 bp, Homo sapiens
  misc_feature: HIJSMM301CNIN2.40.33.C11.1.454.light.4.raw
tctagcgactcacgaccggtgctcgatttagagtgagctcgttgggtttggggagctgggaagcctgagaacacttggccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttatattactgcatgctccatgtgggggtgccacttgggtgttcggcggagggaccaagctgaccgtcaggtcagcccaagg

SEQ ID NO: 549847 - DNA, 496 bp, Homo sapiens
  misc_feature: HIJSMM301CEHAB.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtatttgcagtgtattattgtcagcaatatggtaggtcacctgggactttggccgaggggaccaagctggagatacaaacgaactgtggctgcaccatctgtcttcta

SEQ ID NO: 549848 - DNA, 484 bp, Homo sapiens; identical to SEQ ID NO: 536395
  misc_feature: HIJSMM301B7H3O.46.35.D02.1.454.light.4.raw

SEQ ID NO: 549849 - DNA, 505 bp, Homo sapiens
  misc_feature: HIJSMM301BYUYS.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccgaggctgaccgtcggcggtcagcccaaggctgccccctcggtcactttgttcccaccct

SEQ ID NO: 549850 - DNA, 491 bp, Homo sapiens
  misc_feature: HIJSMM301EONCM.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccta

SEQ ID NO: 549851 - DNA, 491 bp, Homo sapiens
  misc_feature: HIJSMM301BZHXM.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggcctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccgaggggaccaagctggagatacaaacgaactgtggctgcaccat

SEQ ID NO: 549852 - DNA, 490 bp, Homo sapiens; identical to SEQ ID NO: 537658
  misc_feature: HIJSMM301ENN4X.14.55.E11.1.454.light.4.raw

SEQ ID NO: 549853 - DNA, 476 bp, Homo sapiens
  misc_feature: HIJSMM301CLWO0.48.75.G09.1.454.light.4.raw
agtatacatacacgaccggtgctcgatttagtatagacatcaggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcaattccctggagtgccagagaggttcagtggcagcggagcagggacagagttcacactgaaaatcagccgggtggaggctgaggatgttggcctttattactgcatgcaaggtatcttctcccatacacttttggccggggaccaaggtggatctcaaagaa

SEQ ID NO: 549854 - DNA, 515 bp, Homo sapiens
  misc_feature: HIJSMM301AIWVW.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtggccttgggtgttcggcggagggaccaagctgaccgtcctaggtcagcccaaggctgccccctcggtcactctgttcccaccctcctcgacacgcg

SEQ ID NO: 549855 - DNA, 515 bp, Homo sapiens
  misc_feature: HIJSMM301B2ARJ.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgtgctgttggcaactactgtcggtttgggtgttcggcggagggaccaagttcggaccgttcgtaggtcacgcccaaggctcgcccccgtcggtcactcttcgtt

SEQ ID NO: 549856 - DNA, 444 bp, Homo sapiens; identical to SEQ ID NO: 535027
  misc_feature: HIJSMM301D370P.8.73.G07.1.454.light.4.raw

SEQ ID NO: 549857 - DNA, 502 bp, Homo sapiens; identical to SEQ ID NO: 536253
  misc_feature: HIJSMM301AXTZP.21.22.B11.1.454.light.4.raw

SEQ ID NO: 549858 - DNA, 486 bp, Homo sapiens; identical to SEQ ID NO: 535523
  misc_feature: HIJSMM301EHOZJ.22.73.G07.1.454.light.4.raw

SEQ ID NO: 549859 - DNA, 514 bp, Homo sapiens
  misc_feature: HIJSMM301AORYJ.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgagattttgcagtgtattactgtcagcagtatggtagctcacggacgtcggccgaagggaccgaacggtggaaagtacaaacgaactacgtggcgtgcgaccactctgtcttctactcttccccg

SEQ ID NO: 549860 - DNA, 495 bp, Homo sapiens; identical to SEQ ID NO: 546624
  misc_feature: HIJSMM301BJ4IG.52.38.D05.1.454.light.4.raw

SEQ ID NO: 549861 - DNA, 511 bp, Homo sapiens
  misc_feature: HIJSMM301EKUOU.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccta

SEQ ID NO: 549862 - DNA, 495 bp, Homo sapiens
  misc_feature: HIJSMM301AJLHS.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggtccgggggaccgaacggtggaggatcaagcgaactgtggctgcaccatctgtcttcatcttcccg

SEQ ID NO: 549863 - DNA, 445 bp, Homo sapiens; identical to SEQ ID NO: 537719
  misc_feature: HIJSMM301ALPB7.47.85.H08.1.454.light.4.raw

SEQ ID NO: 549864 - DNA, 501 bp, Homo sapiens
  misc_feature: HIJSMM301DZYFQ.2.49.E05.1.454.light.4.raw
acgctcgacacacgaccggtgctcgatttagagcgactagcaacacacaaaggggggggaaggctcagcttcagctgtggtagagaagacaggattcaggacaatctccagcatggccggcttccctctcctcctcacccacctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtctaggt

SEQ ID NO: 549865 - DNA, 515 bp, Homo sapiens
  misc_feature: HIJSMM301DY8UA.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccgccctcctcgagtagtaca

SEQ ID NO: 549866 - DNA, 503 bp, Homo sapiens; identical to SEQ ID NO: 537898
  misc_feature: HIJSMM301EQEGQ.2.21.B10.1.454.light.4.raw

SEQ ID NO: 549867 - DNA, 484 bp, Homo sapiens
  misc_feature: HIJSMM301CS3TM.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtggctgcacatctgt

SEQ ID NO: 549868 - DNA, 493 bp, Homo sapiens; identical to SEQ ID NO: 535047
  misc_feature: HIJSMM301CN0E4.16.53.E09.1.454.light.4.raw

SEQ ID NO: 549869 - DNA, 494 bp, Homo sapiens; identical to SEQ ID NO: 534992
  misc_feature: HIJSMM301EGGN5.9.1.A01.1.454.light.4.raw

SEQ ID NO: 549870 - DNA, 485 bp, Homo sapiens
  misc_feature: HIJSMM301AL40D.10.59.F04.1.454.light.4.raw
catagtagtgcacgaccggtgctcgatttagtacacacacttagggattggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcag

SEQ ID NO: 549871 - DNA, 489 bp, Homo sapiens; identical to SEQ ID NO: 540655
  misc_feature: HIJSMM301DZQN0.22.87.H10.1.454.light.4.raw

SEQ ID NO: 549872 - DNA, 501 bp, Homo sapiens
  misc_feature: HIJSMM301AKB4A.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtaggaaatacaaacgaactgtggctgcaccatctgtcttcta

SEQ ID NO: 549873 - DNA, 513 bp, Homo sapiens
  misc_feature: HIJSMM301BYYUD.13.4.A04.1.454.light.4.raw
tcacgtactacacgaccggtgctcgatttagagtagtgatcagggggcagttggtagatgcccctctgggagagatccccaggggtgacagccatggaccctgtaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaagcggggacccagaccctggagcctcagttggaagcagccgatccagcctgcggagcctgtgggcaggtcagcccaaggccaaccccactcgtcactctgttccccg

SEQ ID NO: 549874 - DNA, 482 bp, Homo sapiens; identical to SEQ ID NO: 535796
  misc_feature: HIJSMM301BLXW8.51.64.F09.1.454.light.4.raw

SEQ ID NO: 549875 - DNA, 488 bp, Homo sapiens; identical to SEQ ID NO: 535861
  misc_feature: HIJSMM301CRUP3.14.55.E11.1.454.light.4.raw

SEQ ID NO: 549876 - DNA, 506 bp, Homo sapiens
  misc_feature: HIJSMM301C9QR2.10.20.B09.1.454.light.4.raw
  modified_base (465)..(465): a, c, t, g, unknown or other
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctacttcgtcccgtcggtacggaacgtaggtagttnttacgacgaacgagtggtcgtgtcgaccactctgtcttctt

SEQ ID NO: 549877 - DNA, 496 bp, Homo sapiens
  misc_feature: HIJSMM301CTL63.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccaaggtggagatcaaacgaactgtggctgcaccatctgtcttcactcttcccgt

SEQ ID NO: 549878 - DNA, 475 bp, Homo sapiens; identical to SEQ ID NO: 537714
  misc_feature: HIJSMM301CW7SR.7.81.H04.1.454.light.4.raw

SEQ ID NO: 549879 - DNA, 494 bp, Homo sapiens; identical to SEQ ID NO: 534992
  misc_feature: HIJSMM301EJOAA.9.1.A01.1.454.light.4.raw

SEQ ID NO: 549880 - DNA, 493 bp, Homo sapiens
  misc_feature: HIJSMM301BIXJY.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccagcagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtctt

SEQ ID NO: 549881 - DNA, 478 bp, Homo sapiens
  misc_feature: HIJSMM301DZU9B.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctggacgttcggccaagggaccaaggtgaaatcaaacgaactgtggctgcacca

SEQ ID NO: 549882 - DNA, 504 bp, Homo sapiens
  misc_feature: HIJSMM301ALBZO.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggagtgaggacacattggtgttcggcggagggaccaagctgaccgtcctacgtcagcccaaggctgccccctcgtcactctgttccccg

SEQ ID NO: 549883 - DNA, 481 bp, Homo sapiens
  misc_feature: HIJSMM301B2G9U.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtgagatcaaagaa

SEQ ID NO: 549884 - DNA, 503 bp, Homo sapiens; identical to SEQ ID NO: 536834
  misc_feature: HIJSMM301A0MST.2.35.D02.1.454.light.4.raw

SEQ ID NO: 549885 - DNA, 465 bp, Homo sapiens
  misc_feature: HIJSMM301BYVFW.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatac

SEQ ID NO: 549886 - DNA, 514 bp, Homo sapiens; identical to SEQ ID NO: 547648
  misc_feature: HIJSMM301EH3TN.16.1.A01.1.454.light.4.raw

SEQ ID NO: 549887 - DNA, 444 bp, Homo sapiens; identical to SEQ ID NO: 534993
  misc_feature: HIJSMM301DV981.5.9.A09.1.454.light.4.raw

SEQ ID NO: 549888 - DNA, 498 bp, Homo sapiens
  misc_feature: HIJSMM301DYAHU.49.41.D08.1.454.light.4.raw
agtcgagagacacgaccggtgctcgatttagtcacgcgagaaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcact

SEQ ID NO: 549889 - DNA, 497 bp, Homo sapiens; identical to SEQ ID NO: 544475
  misc_feature: HIJSMM301BG0U4.12.87.H10.1.454.light.4.raw

SEQ ID NO: 549890 - DNA, 484 bp, Homo sapiens; identical to SEQ ID NO: 535240
  misc_feature: HIJSMM301EELMJ.47.60.F05.1.454.light.4.raw

SEQ ID NO: 549891 - DNA, 463 bp, Homo sapiens; identical to SEQ ID NO: 535062
  misc_feature: HIJSMM301ATTZH.11.73.G07.1.454.light.4.raw

SEQ ID NO: 549892 - DNA, 509 bp, Homo sapiens
  misc_feature: HIJSMM301A2S6M.14.55.E11.1.454.light.4.raw
  modified_base (502)..(502): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttcggtcggacgggacgaacggacggcggatcacgaacgaacctacgtgggcgtcgcaccaactcttcgtntttccta

SEQ ID NO: 549893 - DNA, 487 bp, Homo sapiens; identical to SEQ ID NO: 537220
  misc_feature: HIJSMM301CUMJ6.16.53.E09.1.454.light.4.raw

SEQ ID NO: 549894 - DNA, 501 bp, Homo sapiens; identical to SEQ ID NO: 535746
  misc_feature: HIJSMM301AUTY4.18.11.A11.1.454.light.4.raw

SEQ ID NO: 549895 - DNA, 467 bp, Homo sapiens
  misc_feature: HIJSMM301DB1XU.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaagggtggagatacg

SEQ ID NO: 549896 - DNA, 493 bp, Homo sapiens
  misc_feature: HIJSMM301CESMG.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtctcatt

SEQ ID NO: 549897 - DNA, 486 bp, Homo sapiens
  misc_feature: HIJSMM301BQVW0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcgagatcagacgaactgtggctgcaccatctgtcttca

SEQ ID NO: 549898 - DNA, 462 bp, Homo sapiens
  misc_feature: HIJSMM301EBMW2.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctggaccagagtggacatgaaacgaa

SEQ ID NO: 549899 - DNA, 501 bp, Homo sapiens
  misc_feature: HIJSMM301BYIT7.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctgttccccg

SEQ ID NO: 549900 - DNA, 488 bp, Homo sapiens
  misc_feature: HIJSMM301BHNDV.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttgtccgacggaaccgaacgtaggaagtacaaacgaaactagtggctgcacca

SEQ ID NO: 549901 - DNA, 498 bp, Homo sapiens
  misc_feature: HIJSMM301AQ6QP.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtttattactgtcagcagtatggtagctcaccgtacacttttggccaggggaccaagctggagatcaaacgaactgtggctgcaccatctgtcttcatcttcccgcc

SEQ ID NO: 549902 - DNA, 489 bp, Homo sapiens
  misc_feature: HIJSMM301D8KO1.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctcccccctacaatttcggtcaggggaccaagttgaacatcaatcgaactgtggctgcacca

SEQ ID NO: 549903 - DNA, 505 bp, Homo sapiens
  misc_feature: HIJSMM301BSE7E.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaaggtggagatcaaacgaactgtggctgcaccatctgtcttcatcttcccgccat

SEQ ID NO: 549904 - DNA, 498 bp, Homo sapiens
  misc_feature: HIJSMM301DUE47.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaggtcaccgtcctgggtcagcccaaggcccaaccccactgtcta

SEQ ID NO: 549905 - DNA, 504 bp, Homo sapiens
  misc_feature: HIJSMM301B9ADQ.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccg

SEQ ID NO: 549906 - DNA, 490 bp, Homo sapiens
  misc_feature: HIJSMM301AOS6T.4.27.C05.1.454.light.4.raw
agcactgtagcacgaccggtgctcgatttagacgcgatcgaagggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggtcagggggaccaggctggagatcaaacgaactgt

SEQ ID NO: 549907 - DNA, 493 bp, Homo sapiens; identical to SEQ ID NO: 543949
  misc_feature: HIJSMM301D5ATU.16.68.G02.1.454.light.4.raw

SEQ ID NO: 549908 - DNA, 486 bp, Homo sapiens
  misc_feature: HIJSMM301CMA0M.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactggacccacgttaccgtcctaggtcagacccc

SEQ ID NO: 549909 - DNA, 518 bp, Homo sapiens
  misc_feature: HIJSMM301E2A9Y.15.28.C06.1.454.light.4.raw
  modified_base (416)..(416): a, c, t, g, unknown or other
  modified_base (470)..(470): a, c, t, g, unknown or other
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaagtggggtcccatcaaggttcagcggcagtggatctgggacagaattcagtctcaccatcagcagcctgcagcctgacgattttgtcaacttactactgcacgtagnactaataatactattacgttcggtacgggacgggaaccggtaagggaggagtanaaccgaaaactaacgtaggtgtcgcgccaactactcgttcttctactt

SEQ ID NO: 549910 - DNA, 501 bp, Homo sapiens; identical to SEQ ID NO: 536867
  misc_feature: HIJSMM301BZYGU.5.86.H09.1.454.light.4.raw

SEQ ID NO: 549911 - DNA, 501 bp, Homo sapiens
  misc_feature: HIJSMM301AGPU4.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcact

SEQ ID NO: 549912 - DNA, 490 bp, Homo sapiens; identical to SEQ ID NO: 535936
  misc_feature: HIJSMM301AS7BZ.16.68.G02.1.454.light.4.raw

SEQ ID NO: 549913 - DNA, 495 bp, Homo sapiens; identical to SEQ ID NO: 543094
  misc_feature: HIJSMM301A4EKM.22.57.F02.1.454.light.4.raw

SEQ ID NO: 549914 - DNA, 488 bp, Homo sapiens; identical to SEQ ID NO: 543314
  misc_feature: HIJSMM301AH527.3.33.C11.1.454.light.4.raw

SEQ ID NO: 549915 - DNA, 434 bp, Homo sapiens
  misc_feature: HIJSMM301B4ROC.49.87.H10.1.454.light.4.raw
  modified_base (416)..(416): a, c, t, g, unknown or other
agtcgagagacacgaccggtgctcgatttagcagtactgcgttgggtttggggctggggtctcaggaggcagcgctctggggacgtctcctccatggcctgggctctgctcctcctcacctcctcactcagggcacagaaggggcctcggggacccttgggctgatccttggtctcctgctcctcaggctcacctgggcccagtagtgactcattagagtgtatttctccctctttccaggctcttgggcccagcctgccctgaatcagcctccctccgtgtccgggtctgatggacagtcagtcaccatgtcctgcactggagccagcagtgatgttgggacttgtgactctgtctccaggttccaacaattcccaggtcagcccaaggctgccccctcggtcactctgttcccnccctcctctctctcgact

SEQ ID NO: 549916 - DNA, 485 bp, Homo sapiens; identical to SEQ ID NO: 535606
  misc_feature: HIJSMM301DKNM6.47.46.E02.1.454.light.4.raw

SEQ ID NO: 549917 - DNA, 496 bp, Homo sapiens; identical to SEQ ID NO: 540261
  misc_feature: HIJSMM301BJ73R.3.78.H01.1.454.light.4.raw

SEQ ID NO: 549918 - DNA, 479 bp, Homo sapiens
  misc_feature: HIJSMM301AX4ZE.48.42.D09.1.454.light.4.raw
agtatacatacacgaccggtgctcgatttagacacatacgcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaacgtaggatgtcaaccgaactagtggctgcacca

SEQ ID NO: 549919 - DNA, 488 bp, Homo sapiens
  misc_feature: HIJSMM301EBKSF.5.40.D07.1.454.light.4.raw
  modified_base (481)..(481): a, c, t, g, unknown or other
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaacgggaccgaaggtggagaccaaacgaactagtggcngcaccat

SEQ ID NO: 549920 - DNA, 492 bp, Homo sapiens; identical to SEQ ID NO: 536010
  misc_feature: HIJSMM301CTL9E.10.20.B09.1.454.light.4.raw

SEQ ID NO: 549921 - DNA, 493 bp, Homo sapiens
  misc_feature: HIJSMM301DX5O4.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcggtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcatt

SEQ ID NO: 549922 - DNA, 504 bp, Homo sapiens
  misc_feature: HIJSMM301B20A8.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccgggtccgaggatgaggctgactattactgtgcatcacgggacgcaacatgggatgacaatctgagcggttgggtgttcggcggagggaccaaactgaccgtcctaggtcaggcccaa

SEQ ID NO: 549923 - DNA, 500 bp, Homo sapiens; identical to SEQ ID NO: 546350
  misc_feature: HIJSMM301CJHZ2.51.19.B08.1.454.light.4.raw

SEQ ID NO: 549924 - DNA, 510 bp, Homo sapiens
  misc_feature: HIJSMM301DD7RH.51.53.E09.1.454.light.4.raw
cgatcgtatacacgaccggtgctcgatttagagagagtgtgttgggtttgggggctgggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcact

SEQ ID NO: 549925 - DNA, 494 bp, Homo sapiens; identical to SEQ ID NO: 534994
  misc_feature: HIJSMM301BGM60.27.78.H01.1.454.light.4.raw

SEQ ID NO: 549926 - DNA, 511 bp, Homo sapiens
  misc_feature: HIJSMM301DYSKN.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgcccctaagcggccctccagggtttcgtaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaacggcccaacccccactcgtcactt

SEQ ID NO: 549927 - DNA, 501 bp, Homo sapiens; identical to SEQ ID NO: 535509
  misc_feature: HIJSMM301CEZLZ.15.56.F01.1.454.light.4.raw

SEQ ID NO: 549928 - DNA, 503 bp, Homo sapiens
  misc_feature: HIJSMM301D630T.51.59.F04.1.454.light.4.raw
cgatcgtatacacgaccggtgctcgatttagtacacacacttagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 549929 - DNA, 492 bp, Homo sapiens; identical to SEQ ID NO: 535126
  misc_feature: HIJSMM301EN878.18.11.A11.1.454.light.4.raw

SEQ ID NO: 549930 - DNA, 494 bp, Homo sapiens; identical to SEQ ID NO: 534994
  misc_feature: HIJSMM301DDMHI.27.78.H01.1.454.light.4.raw

SEQ ID NO: 549931 - DNA, 487 bp, Homo sapiens
  misc_feature: HIJSMM301CZ7DR.48.4.A04.1.454.light.4.raw
agtatacatacacgaccggtgctcgatttagagtagtgatcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccagggtggaaagtacaaacgaactagtggctgcaccactctgtcttcatt

SEQ ID NO: 549932 - DNA, 384 bp, Homo sapiens
  misc_feature: HIJSMM301DVP03.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagatttttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 549933 - DNA, 488 bp, Homo sapiens
  misc_feature: HIJSMM301A9TFP.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatacaaacgaactgtggctgcaccatctgtt

SEQ ID NO: 549934 - DNA, 460 bp, Homo sapiens; identical to SEQ ID NO: 536053
  misc_feature: HIJSMM301B4QDD.22.28.C06.1.454.light.4.raw

SEQ ID NO: 549935 - DNA, 463 bp, Homo sapiens; identical to SEQ ID NO: 535062
  misc_feature: HIJSMM301CHFFU.11.73.G07.1.454.light.4.raw

SEQ ID NO: 549936 - DNA, 494 bp, Homo sapiens; identical to SEQ ID NO: 535276
  misc_feature: HIJSMM301EKKCV.16.6.A06.1.454.light.4.raw

SEQ ID NO: 549937 - DNA, 500 bp, Homo sapiens
  misc_feature: HIJSMM301D34QI.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcggtcac

SEQ ID NO: 549938 - DNA, 498 bp, Homo sapiens
  misc_feature: HIJSMM301CIQHF.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctgggaacctgaagattctgcactatattactgtcagctttatgttaattcacctccgtcgtacatctttggccaggggaccaagctggagatcaaacgaactgtggctgcaccatctgtcttcatt

SEQ ID NO: 549939 - DNA, 492 bp, Homo sapiens
  misc_feature: HIJSMM301BDNUC.49.81.H04.1.454.light.4.raw
agtcgagagacacgaccggtgctcgatttagtagtgtagattcgcggggaggtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaacctcctgatctacgatgcatccaatttggaaatagggtcccatcaaggttcagtggaagtggatctgggacgtattttactttcaccatcatcaacctgcagcctgaggatattgcaacattattactgtcaacaatatgataatctaccactcactttcggcggagggaccgaacggtggagagtcaaacgaaacctgtggctgcaccatctgtcttcta

SEQ ID NO: 549940 - DNA, 480 bp, Homo sapiens; identical to SEQ ID NO: 541616
  misc_feature: HIJSMM301DIOFT.21.25.C03.1.454.light.4.raw

SEQ ID NO: 549941 - DNA, 513 bp, Homo sapiens
  misc_feature: HIJSMM301AHJXB.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtaggaaagtacaagacgaaccgtgtggctgcaccactctgtcttctactcttcccgt

SEQ ID NO: 549942 - DNA, 479 bp, Homo sapiens
  misc_feature: HIJSMM301AZUG2.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggaggatcaaacgaaactgtggctgcaccatctgtt

SEQ ID NO: 549943 - DNA, 502 bp, Homo sapiens
  misc_feature: HIJSMM301AKP1T.12.37.D04.1.454.light.4.raw
atacgacgtacacgaccggtgctcgatttagtagcatactgttgggtttgggggcaggagtcagtcccaaccctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaacgcccctagactcctgattcacgaggcatccaattcggaaataggggtcccacgaaggttcagtggaggtggagctgggacagtattttaccctcaccatcagcagcctgcagcctgaagatcttgcaacatattactgtcaacagtataataatctcccgtactacttttggccaggggaccaagctggagatcaaacgaactgtggctgcaccatctgtcttcta

SEQ ID NO: 549944 - DNA, 497 bp, Homo sapiens; identical to SEQ ID NO: 535740
  misc_feature: HIJSMM301BBPMO.3.71.G05.1.454.light.4.raw

SEQ ID NO: 549945 - DNA, 372 bp, Homo sapiens
  misc_feature: HIJSMM301AIJRA.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaagctgaccgtcctaggtcagcccaaggctgccccctcggtcactctgttcccaccctcctccgagcgacga

SEQ ID NO: 549946 - DNA, 506 bp, Homo sapiens; identical to SEQ ID NO: 536038
  misc_feature: HIJSMM301ATFGV.7.71.G05.1.454.light.4.raw

SEQ ID NO: 549947 - DNA, 479 bp, Homo sapiens; identical to SEQ ID NO: 535118
  misc_feature: HIJSMM301DXV84.13.59.F04.1.454.light.4.raw

SEQ ID NO: 549948 - DNA, 494 bp, Homo sapiens
  misc_feature: HIJSMM301D1HST.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcaagcagagtggaggctgaggatgttggggtttattactgcatgcaagctctacaaactccttacacttttggccaggggaccaagctggagatcaaacgaactgtgg

SEQ ID NO: 549949 - DNA, 493 bp, Homo sapiens
  misc_feature: HIJSMM301BCWF5.5.35.D02.1.454.light.4.raw
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 549950 - DNA, 512 bp, Homo sapiens
  misc_feature: HIJSMM301ELZH5.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtctcggtcagccaaggctgccccctcggtcactctgttcccgcctcct

SEQ ID NO: 549951 - DNA, 504 bp, Homo sapiens; identical to SEQ ID NO: 539690
  misc_feature: HIJSMM301BEYS6.47.65.F10.1.454.light.4.raw

SEQ ID NO: 549952 - DNA, 511 bp, Homo sapiens; identical to SEQ ID NO: 535406
  misc_feature: HIJSMM301AMOTA.43.59.F04.1.454.light.4.raw

SEQ ID NO: 549953 - DNA, 502 bp, Homo sapiens; identical to SEQ ID NO: 536930
  misc_feature: HIJSMM301CS1V1.41.45.E01.1.454.light.4.raw

SEQ ID NO: 549954 - DNA, 485 bp, Homo sapiens
  misc_feature: HIJSMM301D3ZR6.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttcta

SEQ ID NO: 549955 - DNA, 505 bp, Homo sapiens
  misc_feature: HIJSMM301DGBFR.2.35.D02.1.454.light.4.raw
  modified_base (474)..(474): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccngggtcagcccaaggcctgccccctcggtcta

SEQ ID NO: 549956 - DNA, 498 bp, Homo sapiens
  misc_feature: HIJSMM301AO1VG.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggtccgggggaccgaacggtaggagatcaagcgaactagtggctgcaccatctgtcttctatcttcccgt

SEQ ID NO: 549957 - DNA, 510 bp, Homo sapiens
  misc_feature: HIJSMM301ASNVB.53.19.B08.1.454.light.4.raw
cgcgtatacacacgaccggtgctcgatttagtgagtcagtaaggggctgggcctaaggaagcagcactggtggtgcctcagccatggcctggaccgttctcctcctcggcctcctctctcactgcacaggttctgtgaccccctatgtcctgactcagccaccctcggtgtcggtggccccaggacaggcggccaccattacctgtgggggagactacattggacgtaaaagtgtgcactggtaccagcaccagccaggccaggcccctatgatgctcctctatgacgatacccaccggccctcagggatccctgagcgattctctggctccaactctgagaacacggccaccctgaccatcagtggggtcgaggccggggatgaggccgtctattactgtcaggtgtgggatagtagtggtgatctgtgggtgttcggcggagggaccacgctgaccgtcctaggtcagcccaaggctgccccctcggtcactctgttcccgccctcct

SEQ ID NO: 549958 - DNA, 496 bp, Homo sapiens
  misc_feature: HIJSMM301A8AZ4.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaaacgaactgtggctgca

SEQ ID NO: 549959 - DNA, 447 bp, Homo sapiens; identical to SEQ ID NO: 535201
  misc_feature: HIJSMM301BG6KZ.18.9.A09.1.454.light.4.raw

SEQ ID NO: 549960 - DNA, 483 bp, Homo sapiens
  misc_feature: HIJSMM301AHMC7.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctgcacc

SEQ ID NO: 549961 - DNA, 498 bp, Homo sapiens
  misc_feature: HIJSMM301CL7ZH.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtca

SEQ ID NO: 549962 - DNA, 491 bp, Homo sapiens
  misc_feature: HIJSMM301CRYQ9.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatctgggaatccggggtccctgaccgattcagtggcagcgggtctgggacagatttcactctcaccatcagcagcctgcaggctgaagatgtggcagtttatactgtcagcaatattatagtactcctccgaggctcactttcggcggagggaccaaggtggagatcaaacgaa

SEQ ID NO: 549963 - DNA, 504 bp, Homo sapiens
  misc_feature: HIJSMM301C3FM8.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 549964 - DNA, 478 bp, Homo sapiens
  misc_feature: HIJSMM301ASOD1.43.87.H10.1.454.light.4.raw
tgtgagtagtcacgaccggtgctcgatttagcagtactgcgttgggttgggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtccta

SEQ ID NO: 549965 - DNA, 485 bp, Homo sapiens
  misc_feature: HIJSMM301ELTZD.40.15.B04.1.454.light.4.raw
tctagcgactcacgaccggtgctcgatttagacagtatatatccgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagccctcctgaccattactggactccagcctgaggacgaggctgactattattgctcagcagtgggacaccagcctcaatgccgcggtattcggcgcgagggaccaagctgaccgtctaggtcacg

SEQ ID NO: 549966 - DNA, 361 bp, Homo sapiens; identical to SEQ ID NO: 540413
  misc_feature: HIJSMM301CBPKQ.3.57.F02.1.454.light.4.raw

SEQ ID NO: 549967 - DNA, 493 bp, Homo sapiens
  misc_feature: HIJSMM301DDG86.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattcactttcggccctgggaccaaagtggatttcagacgaactgtggctgcaccatctgtcttcta

SEQ ID NO: 549968 - DNA, 486 bp, Homo sapiens; identical to SEQ ID NO: 535385
  misc_feature: HIJSMM301ANYXA.19.71.G05.1.454.light.4.raw

SEQ ID NO: 549969 - DNA, 478 bp, Homo sapiens; identical to SEQ ID NO: 535129
  misc_feature: HIJSMM301B9SJ4.11.11.A11.1.454.light.4.raw

SEQ ID NO: 549970 - DNA, 505 bp, Homo sapiens; identical to SEQ ID NO: 535503
  misc_feature: HIJSMM301CQ2HM.8.28.C06.1.454.light.4.raw

SEQ ID NO: 549971 - DNA, 455 bp, Homo sapiens; identical to SEQ ID NO: 539137
  misc_feature: HIJSMM301CSRGH.19.86.H09.1.454.light.4.raw

SEQ ID NO: 549972 - DNA, 390 bp, Homo sapiens
  misc_feature: HIJSMM301EL0SA.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtccctaggtcagcccaaggctgccccctcggtcactctgttcccaccctcctccgagcgacga

SEQ ID NO: 549973 - DNA, 483 bp, Homo sapiens; identical to SEQ ID NO: 549960
  misc_feature: HIJSMM301COW6T.3.88.H11.1.454.light.4.raw

SEQ ID NO: 549974 - DNA, 385 bp, Homo sapiens
  misc_feature: HIJSMM301A6UOB.49.42.D09.1.454.light.4.raw
agtcgagagacacgaccggtgctcgatttagacacatacgcagggaaagggggcgtggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctggggtcagcccaaggccaaccccacctgtcactctgttcccaccctcctctctctcgact

SEQ ID NO: 549975 - DNA, 476 bp, Homo sapiens
  misc_feature: HIJSMM301BL4VG.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaacgaactgtggctgca

SEQ ID NO: 549976 - DNA, 493 bp, Homo sapiens
  misc_feature: HIJSMM301BNLEF.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatccgtcttcatcttcccg

SEQ ID NO: 549977 - DNA, 505 bp, Homo sapiens; identical to SEQ ID NO: 535987
  misc_feature: HIJSMM301A8AWR.18.37.D04.1.454.light.4.raw

SEQ ID NO: 549978 - DNA, 499 bp, Homo sapiens; identical to SEQ ID NO: 536187
  misc_feature: HIJSMM301BVJ7B.11.67.G01.1.454.light.4.raw

SEQ ID NO: 549979 - DNA, 479 bp, Homo sapiens; identical to SEQ ID NO: 535188
  misc_feature: HIJSMM301DMG9J.10.74.G08.1.454.light.4.raw

SEQ ID NO: 549980 - DNA, 495 bp, Homo sapiens; identical to SEQ ID NO: 535596
  misc_feature: HIJSMM301DTOAR.10.79.H02.1.454.light.4.raw

SEQ ID NO: 549981 - DNA, 505 bp, Homo sapiens
  misc_feature: HIJSMM301DIZBM.48.26.C04.1.454.light.4.raw
agtatacatacacgaccggtgctcgatttagtctagcgactttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcgggcggagggaccaagctgaccgtctaggtcagcccaaggctgtccccccg

SEQ ID NO: 549982 - DNA, 492 bp, Homo sapiens
  misc_feature: HIJSMM301EWKQO.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 549983 - DNA, 489 bp, Homo sapiens
  misc_feature: HIJSMM301D7GQ9.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcagggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 549984 - DNA, 417 bp, Homo sapiens
  misc_feature: HIJSMM301DJSC8.10.86.H09.1.454.light.4.raw
catagtagtgcacgaccggtgctcgatttagtgctatagacttgggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 549985 - DNA, 507 bp, Homo sapiens
  misc_feature: HIJSMM301D0JIZ.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcccgaagattttgcagtttattactgtcagcagcgtagcatctggcctccgtacacctttggccagggggaccaagctggagatcaaacgaactgtggctgcaccatctgtcttcatcttccccg

SEQ ID NO: 549986 - DNA, 454 bp, Homo sapiens; identical to SEQ ID NO: 535005
  misc_feature: HIJSMM301CMB6W.19.86.H09.1.454.light.4.raw

SEQ ID NO: 549987 - DNA, 484 bp, Homo sapiens; identical to SEQ ID NO: 535400
  misc_feature: HIJSMM301BHBPP.46.26.C04.1.454.light.4.raw

SEQ ID NO: 549988 - DNA, 523 bp, Homo sapiens
  misc_feature: HIJSMM301B7DYU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggccgacggacgaacggtaggaagtacgaaacgaacgtacgtaggctgcaccactctgtcttctactcttccccctactctcgtat

SEQ ID NO: 549989 - DNA, 490 bp, Homo sapiens; identical to SEQ ID NO: 541407
  misc_feature: HIJSMM301DYZ1Q.14.55.E11.1.454.light.4.raw

SEQ ID NO: 549990 - DNA, 478 bp, Homo sapiens
  misc_feature: HIJSMM301AIH85.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccaggtggaaatcaaacgaactgtggctgcaccat

SEQ ID NO: 549991 - DNA, 498 bp, Homo sapiens
  misc_feature: HIJSMM301CQL78.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatacaaacgaactgtggctgca

SEQ ID NO: 549992 - DNA, 496 bp, Homo sapiens; identical to SEQ ID NO: 535597
  misc_feature: HIJSMM301BLHML.22.20.B09.1.454.light.4.raw

SEQ ID NO: 549993 - DNA, 495 bp, Homo sapiens
  misc_feature: HIJSMM301B7P04.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactagtggctgcaccatctgtctt

SEQ ID NO: 549994 - DNA, 499 bp, Homo sapiens
  misc_feature: HIJSMM301BDPQB.48.61.F06.1.454.light.4.raw
agtatacatacacgaccggtgctcgatttagctacgctctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggcctgccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 549995 - DNA, 503 bp, Homo sapiens
  misc_feature: HIJSMM301CQ8VE.51.23.C01.1.454.light.4.raw
cgatcgtatacacgaccggtgctcgatttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaacgaactgtggctgcaccatctgtcttcatcttcccgccat

SEQ ID NO: 549996 - DNA, 500 bp, Homo sapiens
  misc_feature: HIJSMM301D4RJC.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtccta

SEQ ID NO: 549997 - DNA, 501 bp, Homo sapiens
  misc_feature: HIJSMM301EL2DQ.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttcccg

SEQ ID NO: 549998 - DNA, 519 bp, Homo sapiens
  misc_feature: HIJSMM301C3ZND.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccacct

SEQ ID NO: 549999 - DNA, 477 bp, Homo sapiens; identical to SEQ ID NO: 535506
  misc_feature: HIJSMM301DIRAR.7.67.G01.1.454.light.4.raw

SEQ ID NO: 550000 - DNA, 493 bp, Homo sapiens
  misc_feature: HIJSMM301B6WO7.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttggccaagggacacgactggagattaaacgaactgtggctgcaccatctgtctt

SEQ ID NO: 550001 - DNA, 497 bp, Homo sapiens; identical to SEQ ID NO: 543612
  misc_feature: HIJSMM301BJ4H9.22.27.C05.1.454.light.4.raw

SEQ ID NO: 550002 - DNA, 504 bp, Homo sapiens
  misc_feature: HIJSMM301DZPFS.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctctatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggaagatacaaacgaactgtggctgcaccatctgtctt

SEQ ID NO: 550003 - DNA, 494 bp, Homo sapiens; identical to SEQ ID NO: 535629
  misc_feature: HIJSMM301DT672.4.27.C05.1.454.light.4.raw

SEQ ID NO: 550004 - DNA, 499 bp, Homo sapiens; identical to SEQ ID NO: 548748
  misc_feature: HIJSMM301AM19P.16.78.H01.1.454.light.4.raw

SEQ ID NO: 550005 - DNA, 505 bp, Homo sapiens; identical to SEQ ID NO: 536254
  misc_feature: HIJSMM301ED3CT.7.71.G05.1.454.light.4.raw

SEQ ID NO: 550006 - DNA, 487 bp, Homo sapiens
  misc_feature: HIJSMM301B3I9R.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaacgaactgtggctgcaccatctgtctcat

SEQ ID NO: 550007 - DNA, 488 bp, Homo sapiens; identical to SEQ ID NO: 535081
  misc_feature: HIJSMM301BNQ4T.26.23.C01.1.454.light.4.raw

SEQ ID NO: 550008 - DNA, 444 bp, Homo sapiens; identical to SEQ ID NO: 535192
  misc_feature: HIJSMM301ETUNP.5.9.A09.1.454.light.4.raw

SEQ ID NO: 550009 - DNA, 488 bp, Homo sapiens
  misc_feature: HIJSMM301ERYSR.4.36.D03.1.454.light.4.raw
agcactgtagcacgaccggtgctcgatttagctgcgtcacgatctctcttggggagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagccccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactgtggctgcaccatctgtctt

SEQ ID NO: 550010 - DNA, 447 bp, Homo sapiens; identical to SEQ ID NO: 535020
  misc_feature: HIJSMM301EJIYK.18.9.A09.1.454.light.4.raw

SEQ ID NO: 550011 - DNA, 503 bp, Homo sapiens
  misc_feature: HIJSMM301AKCH5.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagagtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagaccccg

SEQ ID NO: 550012 - DNA, 512 bp, Homo sapiens
  misc_feature: HIJSMM301B9YHX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccaggaccgaacggtggaagtacaaacgaactagtggctgcaccaatctgtcttctatcttcccgtcccact

SEQ ID NO: 550013 - DNA, 492 bp, Homo sapiens; identical to SEQ ID NO: 545637
  misc_feature: HIJSMM301CPIDW.48.1.A01.1.454.light.4.raw

SEQ ID NO: 550014 - DNA, 506 bp, Homo sapiens; identical to SEQ ID NO: 539926
  misc_feature: HIJSMM301BZE0M.5.24.C02.1.454.light.4.raw

SEQ ID NO: 550015 - DNA, 493 bp, Homo sapiens; identical to SEQ ID NO: 536471
  misc_feature: HIJSMM301AUVY1.3.71.G05.1.454.light.4.raw

SEQ ID NO: 550016 - DNA, 444 bp, Homo sapiens
  misc_feature: HIJSMM301CIKAS.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtactagacg

SEQ ID NO: 550017 - DNA, 520 bp, Homo sapiens
  misc_feature: HIJSMM301CJ1NJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtcactctgttcccgccct

SEQ ID NO: 550018 - DNA, 503 bp, Homo sapiens; identical to SEQ ID NO: 535044
  misc_feature: HIJSMM301CTM9F.19.78.H01.1.454.light.4.raw

SEQ ID NO: 550019 - DNA, 514 bp, Homo sapiens; identical to SEQ ID NO: 546238
  misc_feature: HIJSMM301A0N0T.47.85.H08.1.454.light.4.raw

SEQ ID NO: 550020 - DNA, 494 bp, Homo sapiens
  misc_feature: HIJSMM301BENIZ.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 550021 - DNA, 442 bp, Homo sapiens
  misc_feature: HIJSMM301DZCAH.11.3.A03.1.454.light.4.raw
  modified_base (423)..(423): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccnccctcctcgtaatctctcg

SEQ ID NO: 550022 - DNA, 514 bp, Homo sapiens
  misc_feature: HIJSMM301BC3MG.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctcaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccacctcctcg

SEQ ID NO: 550023 - DNA, 512 bp, Homo sapiens
  misc_feature: HIJSMM301B8T9I.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttccgt

SEQ ID NO: 550024 - DNA, 455 bp, Homo sapiens
  misc_feature: HIJSMM301AMI8K.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccaccgagagta

SEQ ID NO: 550025 - DNA, 514 bp, Homo sapiens
  misc_feature: HIJSMM301CXED4.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtccagcccaaggctgccccctcggtcactctgttcccg

SEQ ID NO: 550026 - DNA, 513 bp, Homo sapiens
  misc_feature: HIJSMM301BVUNY.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcggaccaagctgaccgtcctaggtcacgccaaggctcgccccctcggtcactcg

SEQ ID NO: 550027 - DNA, 466 bp, Homo sapiens
  misc_feature: HIJSMM301AL1HM.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtgaccgattctctggctccatgtctggcacctcagcctccctgaccatcagtgggctccggtccgaggatgaggctgattattactgtgcaccgtgggatgacatcctgaatggtccggtgttcggcggagggaccgaggctgaccgtcctaagtcagcccaaggctgccccctcggtcactctgttcccgccctcctcctagtctacg

SEQ ID NO: 550028 - DNA, 481 bp, Homo sapiens; identical to SEQ ID NO: 535993
  misc_feature: HIJSMM301DQBSZ.21.25.C03.1.454.light.4.raw

SEQ ID NO: 550029 - DNA, 480 bp, Homo sapiens; identical to SEQ ID NO: 535291
  misc_feature: HIJSMM301DHBUS.22.59.F04.1.454.light.4.raw

SEQ ID NO: 550030 - DNA, 488 bp, Homo sapiens; identical to SEQ ID NO: 535081
  misc_feature: HIJSMM301A8C9S.26.23.C01.1.454.light.4.raw

SEQ ID NO: 550031 - DNA, 508 bp, Homo sapiens
  misc_feature: HIJSMM301EMSBD.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcaaacgaactgtggctgcaccatctgtctt

SEQ ID NO: 550032 - DNA, 380 bp, Homo sapiens; identical to SEQ ID NO: 537192
  misc_feature: HIJSMM301DXXBK.12.14.B03.1.454.light.4.raw

SEQ ID NO: 550033 - DNA, 508 bp, Homo sapiens; identical to SEQ ID NO: 535649
  misc_feature: HIJSMM301AG9V9.47.55.E11.1.454.light.4.raw

SEQ ID NO: 550034 - DNA, 497 bp, Homo sapiens
  misc_feature: HIJSMM301DQVCY.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccc

SEQ ID NO: 550035 - DNA, 495 bp, Homo sapiens; identical to SEQ ID NO: 535007
  misc_feature: HIJSMM301AYAVC.22.5.A05.1.454.light.4.raw

SEQ ID NO: 550036 - DNA, 485 bp, Homo sapiens; identical to SEQ ID NO: 536630
  misc_feature: HIJSMM301AF5JG.13.56.F01.1.454.light.4.raw

SEQ ID NO: 550037 - DNA, 486 bp, Homo sapiens; identical to SEQ ID NO: 535385
  misc_feature: HIJSMM301EIF8F.19.71.G05.1.454.light.4.raw

SEQ ID NO: 550038 - DNA, 506 bp, Homo sapiens
  misc_feature: HIJSMM301A1REC.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggcctcccgggctcctcatctatggtacatctagcagggccactggcatcccagacaggttcagtggcaggtgggtctgggacagacttcactctcaccatcagcagactggagtctgaagtattttgcagtgtattattgtcagcaatatggtaggtcacctgggtacttttggtccgacggggaccgaacgcgtggagatacaaacgaaactgtggctgcaccatctgtctt

SEQ ID NO: 550039 - DNA, 496 bp, Homo sapiens; identical to SEQ ID NO: 536802
  misc_feature: HIJSMM301A6P8S.5.24.C02.1.454.light.4.raw

SEQ ID NO: 550040 - DNA, 499 bp, Homo sapiens
  misc_feature: HIJSMM301BKEUD.21.38.D05.1.454.light.4.raw
tcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatt

SEQ ID NO: 550041 - DNA, 447 bp, Homo sapiens; identical to SEQ ID NO: 535201
  misc_feature: HIJSMM301DTZ6Y.18.9.A09.1.454.light.4.raw

SEQ ID NO: 550042 - DNA, 447 bp, Homo sapiens
  misc_feature: HIJSMM301AMCYO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcgaccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 550043 - DNA, 505 bp, Homo sapiens; identical to SEQ ID NO: 536117
  misc_feature: HIJSMM301BSUCI.8.71.G05.1.454.light.4.raw

SEQ ID NO: 550044 - DNA, 479 bp, Homo sapiens; identical to SEQ ID NO: 535188
  misc_feature: HIJSMM301DRDFR.10.74.G08.1.454.light.4.raw

SEQ ID NO: 550045 - DNA, 484 bp, Homo sapiens; identical to SEQ ID NO: 535400
  misc_feature: HIJSMM301BV7F4.46.26.C04.1.454.light.4.raw

SEQ ID NO: 550046 - DNA, 512 bp, Homo sapiens; identical to SEQ ID NO: 542831
  misc_feature: HIJSMM301DXZO8.43.19.B08.1.454.light.4.raw

SEQ ID NO: 550047 - DNA, 485 bp, Homo sapiens; identical to SEQ ID NO: 536040
  misc_feature: HIJSMM301EI0O7.15.1.A01.1.454.light.4.raw

SEQ ID NO: 550048 - DNA, 506 bp, Homo sapiens; identical to SEQ ID NO: 539721
  misc_feature: HIJSMM301ANWAM.3.79.H02.1.454.light.4.raw

SEQ ID NO: 550049 - DNA, 499 bp, Homo sapiens
  misc_feature: HIJSMM301EE9Q7.41.35.D02.1.454.light.4.raw
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctgttcccaccctcctcatagtataga

SEQ ID NO: 550050 - DNA, 491 bp, Homo sapiens; identical to SEQ ID NO: 535294
  misc_feature: HIJSMM301BTGCB.16.68.G02.1.454.light.4.raw

SEQ ID NO: 550051 - DNA, 487 bp, Homo sapiens; identical to SEQ ID NO: 541889
  misc_feature: HIJSMM301DXP9I.26.23.C01.1.454.light.4.raw

SEQ ID NO: 550052 - DNA, 492 bp, Homo sapiens; identical to SEQ ID NO: 541945
  misc_feature: HIJSMM301CTAEH.49.67.G01.1.454.light.4.raw

SEQ ID NO: 550053 - DNA, 509 bp, Homo sapiens
  misc_feature: HIJSMM301AOIFO.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactagtggctgcaccatctgtcttcta

SEQ ID NO: 550054 - DNA, 503 bp, Homo sapiens
  misc_feature: HIJSMM301D4CU4.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactacttgcttctcatatgcagatactaagtcctgggtgttcggcggagggaccaagctgaccgtcctaggtcagccaaggctgccccctcggt

SEQ ID NO: 550055 - DNA, 454 bp, Homo sapiens; identical to SEQ ID NO: 536325
  misc_feature: HIJSMM301CCV5T.19.86.H09.1.454.light.4.raw
  modified_base (436)..(436): a, c, t, g, unknown or other

SEQ ID NO: 550056 - DNA, 484 bp, Homo sapiens
  misc_feature: HIJSMM301BSAZO.8.49.E05.1.454.light.4.raw
ctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtggctgcacca

SEQ ID NO: 550057 - DNA, 498 bp, Homo sapiens
  misc_feature: HIJSMM301BEE2V.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaaggaccgaaggtaggaaagtacaaacgaaactagtggcgtgcaccaatctgtctt

SEQ ID NO: 550058 - DNA, 480 bp, Homo sapiens
  misc_feature: HIJSMM301C76QY.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattctgccaacagtatcatacttattctcggaccttcggccaaggaccgaggtggaatacaacgaactagtggcgtgcaccat

SEQ ID NO: 550059 - DNA, 495 bp, Homo sapiens
  misc_feature: HIJSMM301D099S.49.22.B11.1.454.light.4.raw
agtcgagagacacgaccggtgctcgatttagacgacagctcaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgccat

SEQ ID NO: 550060 - DNA, 500 bp, Homo sapiens
  misc_feature: HIJSMM301BH7F1.52.78.H01.1.454.light.4.raw
cgcagtacgacacgaccggtgctcgatttagtgtgagtagtttgggtttggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggttatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcactc

SEQ ID NO: 550061 - DNA, 489 bp, Homo sapiens
  misc_feature: HIJSMM301CG9PL.52.86.H09.1.454.light.4.raw
cgcagtacgacacgaccggtgctcgatttagtgctatagacttggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 550062 - DNA, 509 bp, Homo sapiens; identical to SEQ ID NO: 535670
  misc_feature: HIJSMM301BYNTI.47.23.C01.1.454.light.4.raw

SEQ ID NO: 550063 - DNA, 447 bp, Homo sapiens; identical to SEQ ID NO: 535882
  misc_feature: HIJSMM301C9MWE.18.9.A09.1.454.light.4.raw
  modified_base (429)..(429): a, c, t, g, unknown or other

SEQ ID NO: 550064 - DNA, 509 bp, Homo sapiens
  misc_feature: HIJSMM301BS8N0.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaaactgtggcgtgcaccatctgtt

SEQ ID NO: 550065 - DNA, 492 bp, Homo sapiens; identical to SEQ ID NO: 548815
  misc_feature: HIJSMM301CVQ71.22.65.F10.1.454.light.4.raw

SEQ ID NO: 550066 - DNA, 494 bp, Homo sapiens; identical to SEQ ID NO: 534992
  misc_feature: HIJSMM301AF5IS.9.1.A01.1.454.light.4.raw

SEQ ID NO: 550067 - DNA, 509 bp, Homo sapiens
  misc_feature: HIJSMM301AUD4H.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtcctcctggacagtcagtcaccatctcctgcactggaaccagcagtgacgaagtatttttataagtatgtctcctggtaccaacaacgcccaggcaaacgcccccaagctcatgatttatgaggtcattaagccggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcacttctgttcccgcctcctccgtgt

SEQ ID NO: 550068 - DNA, 488 bp, Homo sapiens
  misc_feature: HIJSMM301BPL1N.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccatctctgggctccaggctgaggacgaggctgactattactgcagttcatatacaagcagcagcactctcgtggtattcggcggagggaccaagctgaccgtcctaggtcacg

SEQ ID NO: 550069 - DNA, 497 bp, Homo sapiens
  misc_feature: HIJSMM301A144H.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatacaaacgaaactgtggctgcacccatctgtctt

SEQ ID NO: 550070 - DNA, 472 bp, Homo sapiens; identical to SEQ ID NO: 536302
  misc_feature: HIJSMM301DPR29.18.76.G10.1.454.light.4.raw

SEQ ID NO: 550071 - DNA, 486 bp, Homo sapiens; identical to SEQ ID NO: 537310
  misc_feature: HIJSMM301D5JS7.15.28.C06.1.454.light.4.raw

SEQ ID NO: 550072 - DNA, 487 bp, Homo sapiens; identical to SEQ ID NO: 537079
  misc_feature: HIJSMM301BHHIT.14.55.E11.1.454.light.4.raw

SEQ ID NO: 550073 - DNA, 494 bp, Homo sapiens; identical to SEQ ID NO: 534994
  misc_feature: HIJSMM301ETHZM.27.78.H01.1.454.light.4.raw

SEQ ID NO: 550074 - DNA, 493 bp, Homo sapiens
  misc_feature: HIJSMM301BBUWK.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggcgtgaggagtgttggcatttattactgcatgcaggctatacaccttcctgccacttttggtccgagggaccgaagactggagatcaggcgaacg

SEQ ID NO: 550075 - DNA, 488 bp, Homo sapiens; identical to SEQ ID NO: 535990
  misc_feature: HIJSMM301AYK74.11.28.C06.1.454.light.4.raw

SEQ ID NO: 550076 - DNA, 489 bp, Homo sapiens
  misc_feature: HIJSMM301C4WLZ.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaattttactactgtcaacagagtgacaatacccctcagactttcggccctggaccagagtggatatcaaacgaactgtggctgcaccatctgtcttcatt

SEQ ID NO: 550077 - DNA, 502 bp, Homo sapiens; identical to SEQ ID NO: 536253
  misc_feature: HIJSMM301EASSD.21.22.B11.1.454.light.4.raw

SEQ ID NO: 550078 - DNA, 497 bp, Homo sapiens
  misc_feature: HIJSMM301EDM69.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaggtgaccgtcctaggtcagcccaaggctcgccccctcgg

SEQ ID NO: 550079 - DNA, 493 bp, Homo sapiens; identical to SEQ ID NO: 535745
  misc_feature: HIJSMM301AKJGO.47.78.H01.1.454.light.4.raw

SEQ ID NO: 550080 - DNA, 495 bp, Homo sapiens; identical to SEQ ID NO: 541828
  misc_feature: HIJSMM301BS624.19.71.G05.1.454.light.4.raw

SEQ ID NO: 550081 - DNA, 495 bp, Homo sapiens
  misc_feature: HIJSMM301AMOP1.43.39.D06.1.454.light.4.raw
tgtgagtagtcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 550082 - DNA, 497 bp, Homo sapiens; identical to SEQ ID NO: 535664
  misc_feature: HIJSMM301CYG7B.22.14.B03.1.454.light.4.raw

SEQ ID NO: 550083 - DNA, 498 bp, Homo sapiens
  misc_feature: HIJSMM301BPACF.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaactggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacaccttttggccaggggaccaagctggagatcaaacgaactgtggtcg

SEQ ID NO: 550084 - DNA, 488 bp, Homo sapiens
  misc_feature: HIJSMM301AXDWF.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatacaaacgaa

SEQ ID NO: 550085 - DNA, 505 bp, Homo sapiens; identical to SEQ ID NO: 539292
  misc_feature: HIJSMM301CBMZJ.19.85.H08.1.454.light.4.raw

SEQ ID NO: 550086 - DNA, 511 bp, Homo sapiens
  misc_feature: HIJSMM301EKX0I.51.53.E09.1.454.light.4.raw
cgatcgtatacacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcact

SEQ ID NO: 550087 - DNA, 505 bp, Homo sapiens
  misc_feature: HIJSMM301DQZAZ.9.12.B01.1.454.light.4.raw
  modified_base (429)..(429): a, c, t, g, unknown or other
tgatacgtctcacgaccggtgctcgatttagtagtgtagattccgcggggaacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttcncgggcgttcggccaagggaccaaggtaggaaatacaaacgaactagtggctgcaccatctgtcttcatcttccccg

SEQ ID NO: 550088 - DNA, 502 bp, Homo sapiens; identical to SEQ ID NO: 537363
  misc_feature: HIJSMM301CSQN0.18.23.C01.1.454.light.4.raw

SEQ ID NO: 550089 - DNA, 516 bp, Homo sapiens
  misc_feature: HIJSMM301A7GCD.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcattctcg

SEQ ID NO: 550090 - DNA, 491 bp, Homo sapiens
  misc_feature: HIJSMM301CMQVL.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccgaaggtggaggtcaaacgaactgtggctgcaccatctgtcttcat

SEQ ID NO: 550091 - DNA, 489 bp, Homo sapiens
  misc_feature: HIJSMM301BGT6M.11.12.B01.1.454.light.4.raw
cgagagataccacgaccggtgctcgatttagtagtgtagattccgcgggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaagg

SEQ ID NO: 550092 - DNA, 489 bp, Homo sapiens
  misc_feature: HIJSMM301BTUYX.40.32.C10.1.454.light.4.raw
tctagcgactcacgaccggtgctcgatttagtatagacatcaacacacaaagggggaggaactgctcagttaggacccagagggaaccatggaagccccagctcagcttctcttcctcctgctactctggctcccagttatcaccggagacattgtattgacacagtctccagccaccctgtctttatctccgggggaaagagccaccttctcctgcagggccagtcagagtgttagcatctacttagcctggtaccaacaaagacctggccaggctcccaggctcctcatctatgatgcatccaccagggccactggcatcccagacaggttcagtggcagtgggtctgggacagacttcactctcaccatcagcagcctagagcctgaagattttggcgtttattactgtcagcagcgtgacagttggcctgcgcacagctttggccaggggaccaagctggaggtcaaacgaactgtggctgcacc

SEQ ID NO: 550093 - DNA, 494 bp, Homo sapiens
  misc_feature: HIJSMM301AW17H.10.33.C11.1.454.light.4.raw
catagtagtgcacgaccggtgctcgatttagagtgagctcgttgggtttgggggagtcgagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcat

SEQ ID NO: 550094 - DNA, 508 bp, Homo sapiens; identical to SEQ ID NO: 537871
  misc_feature: HIJSMM301C0M0N.8.33.C11.1.454.light.4.raw

SEQ ID NO: 550095 - DNA, 507 bp, Homo sapiens
  misc_feature: HIJSMM301EQE5H.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaaggtaggaaagtacaaacgaactagtggctgcaccatctgtcttctatcttcccgtcca

SEQ ID NO: 550096 - DNA, 478 bp, Homo sapiens
  misc_feature: HIJSMM301CB2LO.11.84.H07.1.454.light.4.raw
cgagagataccacgaccggtgctcgatttagcagacgtctgtcgcgggagtggagaccaccacaccctccaaacaaagcaacaacaagtacgcggccagcagctacctgagcctgacgcctgagcagtggaagtcccacaaaagctacagctgccaggtcacgcatgaagggagcaccatggcctggactcctctctttctgttcctcctcacttgctgcccagggtcccattctcagactgtggtgactcaggagccctcactgactgtgtccccaggaggcacagtcactctcacctgtgcttccagcactggagcagtcaccaatggattccatccaaactggttccagcagaaacctggacaaccacccagggcactcatttatagtacaaacaacagacactcctggacccctgaccggttctcaggctccctccttgggggcagagctgccctgacactgtcaggtgtgcag

SEQ ID NO: 550097 - DNA, 505 bp, Homo sapiens
  misc_feature: HIJSMM301A0GZX.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgtt

SEQ ID NO: 550098 - DNA, 484 bp, Homo sapiens
  misc_feature: HIJSMM301BV72U.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaa

SEQ ID NO: 550099 - DNA, 444 bp, Homo sapiens; identical to SEQ ID NO: 535594
  misc_feature: HIJSMM301AXPL7.9.9.A09.1.454.light.4.raw

SEQ ID NO: 550100 - DNA, 479 bp, Homo sapiens; identical to SEQ ID NO: 537163
  misc_feature: HIJSMM301C3DAS.13.73.G07.1.454.light.4.raw

SEQ ID NO: 550101 - DNA, 447 bp, Homo sapiens; identical to SEQ ID NO: 535020
  misc_feature: HIJSMM301AZZU1.18.9.A09.1.454.light.4.raw

SEQ ID NO: 550102 - DNA, 485 bp, Homo sapiens
  misc_feature: HIJSMM301COZII.41.50.E06.1.454.light.4.raw
tctatactatcacgaccggtgctcgatttagatctactgacaacacacaaggggtgatcaggactcctcagttcaccttctcacaatgaggctccctgctcagctcctggggctgctaatgctctgggtctctggatccactggggctgttgtgatgacacagtctccactctccctgcccatcacccctggcgagccggcctccatctcctgtaggtctagtctgagcctcctgtctagtagtggagacaactatttggattggtacctgcagaagccagggcagtctccacaactcctgatttatttgggttttcatcgggcctccggggtccctgacaggttcagtggcagtggatcaggcacagattttacactgagtatcagcacagtggaggctgaggatgttggggtttattattgtgtgcaaactctacactccacgtggacgttcggccacgggacgagggtggatatcaaacgaa

SEQ ID NO: 550103 - DNA, 488 bp, Homo sapiens; identical to SEQ ID NO: 535081
  misc_feature: HIJSMM301EINBA.26.23.C01.1.454.light.4.raw

SEQ ID NO: 550104 - DNA, 484 bp, Homo sapiens
  misc_feature: HIJSMM301DUKFY.3.55.E11.1.454.light.4.raw
  modified_base (475)..(475): a, c, t, g, unknown or other
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggcccctggcatcccagacaggttcagtggcagtgggtctgggacagacttcactctcaccatcagcagactggagcctgaagatttgtcagtgtattactgtcaggtctatggttaactcacctcggttcagcttaggccaggggaccaaggtgagatcaacgaacngtgctgcac

SEQ ID NO: 550105 - DNA, 475 bp, Homo sapiens
  misc_feature: HIJSMM301D32ZJ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcgtagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 550106 - DNA, 509 bp, Homo sapiens
  misc_feature: HIJSMM301DW9I0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtaggaaagtacaaacgaactagtggctgcaccatctgtcttctatcttccccg

SEQ ID NO: 550107 - DNA, 488 bp, Homo sapiens
  misc_feature: HIJSMM301ARZ3T.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgtcgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttca

SEQ ID NO: 550108 - DNA, 422 bp, Homo sapiens; identical to SEQ ID NO: 447881
  misc_feature: HIJSMM301CID84.9.34.D01.1.454.light.4.raw

SEQ ID NO: 550109 - DNA, 492 bp, Homo sapiens
  misc_feature: HIJSMM301BTTI3.43.78.H01.1.454.light.4.raw
tgtgagtagtcacgaccggtgctcgatttagtgtgagtagtttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtgg

SEQ ID NO: 550110 - DNA, 502 bp, Homo sapiens
  misc_feature: HIJSMM301AZC7U.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcgccaagggaccagggtggaaatcagacgaactgtggctgcaccat

SEQ ID NO: 550111 - DNA, 476 bp, Homo sapiens; identical to SEQ ID NO: 537812
  misc_feature: HIJSMM301B3UGE.3.82.H05.1.454.light.4.raw

SEQ ID NO: 550112 - DNA, 515 bp, Homo sapiens
  misc_feature: HIJSMM301C7A7E.49.17.B06.1.454.light.4.raw
agtcgagagacacgaccggtgctcgatttagtcgatagtgaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccgcctcct

SEQ ID NO: 550113 - DNA, 496 bp, Homo sapiens
  misc_feature: HIJSMM301A0TA1.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactcctctgacgttcggccaagggaccaaggtggagatacaaacgaactgtggctgcaccat

SEQ ID NO: 550114 - DNA, 491 bp, Homo sapiens
  misc_feature: HIJSMM301BLO4J.27.78.H01.1.454.light.4.raw
  modified_base (475)..(475): a, c, t, g, unknown or other
  modified_base (489)..(489): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaatgatcaccttcgccaaggacgacgactggagattaaagaaactgtggntcgcaccatctgtntt

SEQ ID NO: 550115 - DNA, 506 bp, Homo sapiens; identical to SEQ ID NO: 535058
  misc_feature: HIJSMM301CEY8X.17.41.D08.1.454.light.4.raw

SEQ ID NO: 550116 - DNA, 444 bp, Homo sapiens; identical to SEQ ID NO: 534993
  misc_feature: HIJSMM301D268H.5.9.A09.1.454.light.4.raw

SEQ ID NO: 550117 - DNA, 505 bp, Homo sapiens
  misc_feature: HIJSMM301DT7N4.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcgacgttcgccaaggaccaggtggagtcaagcgaactgtggctgcaccatctgtcttcatcttcccgccat

SEQ ID NO: 550118 - DNA, 508 bp, Homo sapiens
  misc_feature: HIJSMM301CTTVI.11.57.F02.1.454.light.4.raw
  modified_base (124)..(124): a, c, t, g, unknown or other
cgagagataccacgaccggtgctcgatttagctcgatatagttgggtttgggggaggaactgctcagttaggacccagagggaaccatggaagccccagctcagcttctcttcctcctgctacnctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 550119 - DNA, 504 bp, Homo sapiens; identical to SEQ ID NO: 535077
  misc_feature: HIJSMM301AK93Y.8.28.C06.1.454.light.4.raw

SEQ ID NO: 550120 - DNA, 486 bp, Homo sapiens; identical to SEQ ID NO: 535043
  misc_feature: HIJSMM301EV731.46.35.D02.1.454.light.4.raw

SEQ ID NO: 550121 - DNA, 441 bp, Homo sapiens; identical to SEQ ID NO: 535074
  misc_feature: HIJSMM301CF64O.11.3.A03.1.454.light.4.raw

SEQ ID NO: 550122 - DNA, 501 bp, Homo sapiens
  misc_feature: HIJSMM301DZPJZ.51.19.B08.1.454.light.4.raw
cgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacaatagtttcctggtgttcggcggagggaccaagttgaccgtcctaggtcagcccaaggctgccccctcggtcact

SEQ ID NO: 550123 - DNA, 486 bp, Homo sapiens
  misc_feature: HIJSMM301BX62F.19.71.G05.1.454.light.4.raw
  modified_base (431)..(431): a, c, t, g, unknown or other
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtgcagtttatattgtcaanatattattatacttcgtgacgttcggccaagggaccaaggtggatatcagacgaa

SEQ ID NO: 550124 - DNA, 484 bp, Homo sapiens; identical to SEQ ID NO: 537086
  misc_feature: HIJSMM301DJUWB.5.39.D06.1.454.light.4.raw

SEQ ID NO: 550125 - DNA, 515 bp, Homo sapiens
  misc_feature: HIJSMM301A0HIG.43.19.B08.1.454.light.4.raw
tgtgagtagtcacgaccggtgctcgatttagtgagtcagtaagggggggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcctcactact

SEQ ID NO: 550126 - DNA, 494 bp, Homo sapiens
  misc_feature: HIJSMM301CLMG8.51.35.D02.1.454.light.4.raw
cgatcgtatacacgaccggtgctcgatttagcacacgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 550127 - DNA, 509 bp, Homo sapiens; identical to SEQ ID NO: 535670
  misc_feature: HIJSMM301DOCE6.47.23.C01.1.454.light.4.raw

SEQ ID NO: 550128 - DNA, 497 bp, Homo sapiens
  misc_feature: HIJSMM301B6EU9.12.31.C09.1.454.light.4.raw
atacgacgtacacgaccggtgctcgatttagacgtctcatcaaggaaggaaggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcacttcgtccgacggacgacgaccggaccagatgtacggaactagtggcgtgcaccaactc

SEQ ID NO: 550129 - DNA, 479 bp, Homo sapiens
  misc_feature: HIJSMM301BLWZ5.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccgaaggtggaaatcaaacgaactagtggctgcaccat

SEQ ID NO: 550130 - DNA, 494 bp, Homo sapiens
  misc_feature: HIJSMM301AZYBU.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactgtggctgcaccatctgtcttcatt

SEQ ID NO: 550131 - DNA, 501 bp, Homo sapiens; identical to SEQ ID NO: 535746
  misc_feature: HIJSMM301B3128.18.11.A11.1.454.light.4.raw

SEQ ID NO: 550132 - DNA, 487 bp, Homo sapiens
  misc_feature: HIJSMM301CVH2H.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtctgagtcagcccaaggccaa

SEQ ID NO: 550133 - DNA, 490 bp, Homo sapiens; identical to SEQ ID NO: 536481
  misc_feature: HIJSMM301C5N2K.13.46.E02.1.454.light.4.raw

SEQ ID NO: 550134 - DNA, 446 bp, Homo sapiens; identical to SEQ ID NO: 537330
  misc_feature: HIJSMM301AOL93.18.9.A09.1.454.light.4.raw

SEQ ID NO: 550135 - DNA, 490 bp, Homo sapiens; identical to SEQ ID NO: 541141
  misc_feature: HIJSMM301AWYXS.47.38.D05.1.454.light.4.raw

SEQ ID NO: 550136 - DNA, 480 bp, Homo sapiens; identical to SEQ ID NO: 535291
  misc_feature: HIJSMM301CDVRY.22.59.F04.1.454.light.4.raw

SEQ ID NO: 550137 - DNA, 491 bp, Homo sapiens
  misc_feature: HIJSMM301BRDJZ.48.53.E09.1.454.light.4.raw
agtatacatacacgaccggtgctcgatttagagagagtgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgtagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcacca

SEQ ID NO: 550138 - DNA, 485 bp, Homo sapiens; identical to SEQ ID NO: 536263
  misc_feature: HIJSMM301BA3VP.47.78.H01.1.454.light.4.raw

SEQ ID NO: 550139 - DNA, 501 bp, Homo sapiens
  misc_feature: HIJSMM301BO8GL.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccaccctcctcgctacgtaga

SEQ ID NO: 550140 - DNA, 507 bp, Homo sapiens
  misc_feature: HIJSMM301ATZMC.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactcgtcactctgttccccg

SEQ ID NO: 550141 - DNA, 454 bp, Homo sapiens; identical to SEQ ID NO: 536943
  misc_feature: HIJSMM301D8IM9.19.86.H09.1.454.light.4.raw

SEQ ID NO: 550142 - DNA, 487 bp, Homo sapiens
  misc_feature: HIJSMM301CESPY.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcaggtgggtctgggacagagttctctctcatcatcagcagcctgcagtctgaagtattttgcggtttattactgtcagcagtataatcagtggcctccgtggacgttcggccaagggaccaaggtggaaatacaaacgaactgtgg

SEQ ID NO: 550143 - DNA, 493 bp, Homo sapiens
  misc_feature: HIJSMM301E3MLY.47.70.G04.1.454.light.4.raw
  modified_base (488)..(488): a, c, t, g, unknown or other
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgagattttgcaacttactactgtcaacagagttacggtacccgacctacttagtcgacggacgaacagtacgatacaacgaactacgtggtcgcgtcaccaactntcgtt

SEQ ID NO: 550144 - DNA, 499 bp, Homo sapiens; identical to SEQ ID NO: 543600
  misc_feature: HIJSMM301EGGHF.14.23.C01.1.454.light.4.raw

SEQ ID NO: 550145 - DNA, 502 bp, Homo sapiens
  misc_feature: HIJSMM301COE4T.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagttaccatctcctgcactggaggcagcagtgacgttggcggttataactatgtctcctggtatcaacaacacccggcgaagcccccaaactcctcatttatgaggtcactaagcggcccttaggggtccctgatcgcttctctggctccaagtctggcagaacggcctcctgaccgtctctgggctccaagctgaggatgaggctgattattactgcagctcatatgcaggcagcagcaatgtacttttcggcggagggaccaaggctgaccgtcctggtcagcccaaggctgcccctcggtcact

SEQ ID NO: 550146 - DNA, 473 bp, Homo sapiens; identical to SEQ ID NO: 546369
  misc_feature: HIJSMM301BWOJM.18.76.G10.1.454.light.4.raw

SEQ ID NO: 550147 - DNA, 441 bp, Homo sapiens; identical to SEQ ID NO: 535074
  misc_feature: HIJSMM301BGVQM.11.3.A03.1.454.light.4.raw

SEQ ID NO: 550148 - DNA, 487 bp, Homo sapiens; identical to SEQ ID NO: 546145
  misc_feature: HIJSMM301DKL3M.12.31.C09.1.454.light.4.raw

SEQ ID NO: 550149 - DNA, 484 bp, Homo sapiens; identical to SEQ ID NO: 544689
  misc_feature: HIJSMM301CGKOA.22.6.A06.1.454.light.4.raw

SEQ ID NO: 550150 - DNA, 507 bp, Homo sapiens
  misc_feature: HIJSMM301CZ4RO.27.78.H01.1.454.light.4.raw
  modified_base (395)..(395): a, c, t, g, unknown or other
  modified_base (439)..(439): a, c, t, g, unknown or other
agcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactcggtaccagcagaagccaggtcagtctccaaagctcctcatcaagtatgcttcccagtccttctcaggggtcccctcgaggttcagtggcagtggatctgggacacatttcaccctnaccatcaatagcctggaagctgaagatgctgcaacttattaccngtcatcagagtactactttacctcaagtgatcaccttcggccaagggacacgactggagattaaaacg

SEQ ID NO: 550151 - DNA, 504 bp, Homo sapiens
  misc_feature: HIJSMM301EY0WB.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 550152 - DNA, 494 bp, Homo sapiens; identical to SEQ ID NO: 535497
  misc_feature: HIJSMM301CKN9Q.43.72.G06.1.454.light.4.raw

SEQ ID NO: 550153 - DNA, 453 bp, Homo sapiens
  misc_feature: HIJSMM301EGX8Q.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctcatactcgta

SEQ ID NO: 550154 - DNA, 501 bp, Homo sapiens
  misc_feature: HIJSMM301ECUQC.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaataagaggtcaacgaactgtggctgcaccatctgtcttcat

SEQ ID NO: 550155 - DNA, 455 bp, Homo sapiens
  misc_feature: HIJSMM301EQLGU.5.86.H09.1.454.light.4.raw
atcagacacgcacgaccggtgctcgatttagtgctatagacttgggtttggggggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcactctgttcccaccctcctccgtgtctgat

SEQ ID NO: 550156 - DNA, 494 bp, Homo sapiens; identical to SEQ ID NO: 550130
  misc_feature: HIJSMM301C2XI2.12.38.D05.1.454.light.4.raw

SEQ ID NO: 550157 - DNA, 500 bp, Homo sapiens
  misc_feature: HIJSMM301BMIS3.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagatttgcagtttattactgtcagcagcgggcaattggccgctcactttcggcgggggaccgaaggtggagttcaacgaactgtggctgcaccatctgtcttcatcttcccg

SEQ ID NO: 550158 - DNA, 507 bp, Homo sapiens; identical to SEQ ID NO: 549050
  misc_feature: HIJSMM301AQ1LE.18.37.D04.1.454.light.4.raw

SEQ ID NO: 550159 - DNA, 504 bp, Homo sapiens
  misc_feature: HIJSMM301DQZ4C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacggaccaaggtggaaagtcaaacgaactagtggctgcaccatctgtcttcatcttccccg

SEQ ID NO: 550160 - DNA, 444 bp, Homo sapiens; identical to SEQ ID NO: 535027
  misc_feature: HIJSMM301ALXEH.8.73.G07.1.454.light.4.raw

SEQ ID NO: 550161 - DNA, 483 bp, Homo sapiens
  misc_feature: HIJSMM301AJJ9Q.4.1.A01.1.454.light.4.raw
agcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttca

SEQ ID NO: 550162 - DNA, 497 bp, Homo sapiens; identical to SEQ ID NO: 549756
  misc_feature: HIJSMM301EMKD8.40.57.F02.1.454.light.4.raw

SEQ ID NO: 550163 - DNA, 493 bp, Homo sapiens; identical to SEQ ID NO: 543205
  misc_feature: HIJSMM301D3CWL.51.6.A06.1.454.light.4.raw

SEQ ID NO: 550164 - DNA, 447 bp, Homo sapiens; identical to SEQ ID NO: 535201
  misc_feature: HIJSMM301EJPSW.18.9.A09.1.454.light.4.raw

SEQ ID NO: 550165 - DNA, 493 bp, Homo sapiens; identical to SEQ ID NO: 544335
  misc_feature: HIJSMM301BDIFU.5.57.F02.1.454.light.4.raw

SEQ ID NO: 550166 - DNA, 494 bp, Homo sapiens; identical to SEQ ID NO: 534992
  misc_feature: HIJSMM301D13TJ.9.1.A01.1.454.light.4.raw

SEQ ID NO: 550167 - DNA, 485 bp, Homo sapiens; identical to SEQ ID NO: 542735
  misc_feature: HIJSMM301DTF29.26.45.E01.1.454.light.4.raw

SEQ ID NO: 550168 - DNA, 502 bp, Homo sapiens
  misc_feature: HIJSMM301B2UQ2.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggggacacggtcaccgtccctaggtcagcccaaggccaacccccta

SEQ ID NO: 550169 - DNA, 493 bp, Homo sapiens
  misc_feature: HIJSMM301A9EO3.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcggcccagggaccacacgtggatatcaggcgaactgtggctgcaccatctgtctt

SEQ ID NO: 550170 - DNA, 481 bp, Homo sapiens; identical to SEQ ID NO: 539712
  misc_feature: HIJSMM301ALPM4.51.60.F05.1.454.light.4.raw

SEQ ID NO: 550171 - DNA, 455 bp, Homo sapiens; identical to SEQ ID NO: 535447
  misc_feature: HIJSMM301EU81M.19.71.G05.1.454.light.4.raw

SEQ ID NO: 550172 - DNA, 503 bp, Homo sapiens; identical to SEQ ID NO: 537841
  misc_feature: HIJSMM301ENFR2.48.71.G05.1.454.light.4.raw

SEQ ID NO: 550173 - DNA, 503 bp, Homo sapiens
  misc_feature: HIJSMM301B4IHA.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatct

SEQ ID NO: 550174 - DNA, 488 bp, Homo sapiens; identical to SEQ ID NO: 537260
  misc_feature: HIJSMM301CSPAB.47.70.G04.1.454.light.4.raw

SEQ ID NO: 550175 - DNA, 487 bp, Homo sapiens
  misc_feature: HIJSMM301CH3SQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggcctgcaccat

SEQ ID NO: 550176 - DNA, 486 bp, Homo sapiens; identical to SEQ ID NO: 535043
  misc_feature: HIJSMM301CZK4N.46.35.D02.1.454.light.4.raw

SEQ ID NO: 550177 - DNA, 504 bp, Homo sapiens
  misc_feature: HIJSMM301DYQNQ.49.47.E03.1.454.light.4.raw
agtcgagagacacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgaggggtcttcggcggagggaccaagctgaccgtcctaggtcagcccaaggctcgccccctcggtcactctcg

SEQ ID NO: 550178 - DNA, 472 bp, Homo sapiens; identical to SEQ ID NO: 536302
  misc_feature: HIJSMM301CUS2K.18.76.G10.1.454.light.4.raw

SEQ ID NO: 550179 - DNA, 493 bp, Homo sapiens
  misc_feature: HIJSMM301D43UA.49.30.C08.1.454.light.4.raw
agtcgagagacacgaccggtgctcgatttagtctgacgtcaaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 550180 - DNA, 508 bp, Homo sapiens
  misc_feature: HIJSMM301BNRXT.48.53.E09.1.454.light.4.raw
agtatacatacacgaccggtgctcgatttagagagagtgtgttgggtttgggcttgatgccttggggtgggaggagagacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctcctcctatgtatact

SEQ ID NO: 550181 - DNA, 502 bp, Homo sapiens
  misc_feature: HIJSMM301CI4JP.43.71.G05.1.454.light.4.raw
tgtgagtagtcacgaccggtgctcgatttagtgtcgtcgcaagagagaggggggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggcccaagggacacgactggagattaaccgaactgtggctgcaccatctgtcttcatcttcccg

SEQ ID NO: 550182 - DNA, 499 bp, Homo sapiens; identical to SEQ ID NO: 543600
  misc_feature: HIJSMM301C4IBJ.14.23.C01.1.454.light.4.raw

SEQ ID NO: 550183 - DNA, 498 bp, Homo sapiens
  misc_feature: HIJSMM301ARDKH.52.2.A02.1.454.light.4.raw
cgcagtacgacacgaccggtgctcgatttagactcatctacaggggaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccaccctcctctatacgatcg

SEQ ID NO: 550184 - DNA, 447 bp, Homo sapiens; identical to SEQ ID NO: 535201
  misc_feature: HIJSMM301CX8CJ.18.9.A09.1.454.light.4.raw

SEQ ID NO: 550185 - DNA, 520 bp, Homo sapiens; identical to SEQ ID NO: 538570
  misc_feature: HIJSMM301CBOOU.27.23.C01.1.454.light.4.raw

SEQ ID NO: 550186 - DNA, 486 bp, Homo sapiens; identical to SEQ ID NO: 535043
  misc_feature: HIJSMM301AW31K.46.35.D02.1.454.light.4.raw

SEQ ID NO: 550187 - DNA, 489 bp, Homo sapiens; identical to SEQ ID NO: 535091
  misc_feature: HIJSMM301BTTTE.47.36.D03.1.454.light.4.raw

SEQ ID NO: 550188 - DNA, 467 bp, Homo sapiens; identical to SEQ ID NO: 538403
  misc_feature: HIJSMM301CW2C8.41.48.E04.1.454.light.4.raw

SEQ ID NO: 550189 - DNA, 496 bp, Homo sapiens; identical to SEQ ID NO: 545357
  misc_feature: HIJSMM301CBW5Y.43.49.E05.1.454.light.4.raw

SEQ ID NO: 550190 - DNA, 504 bp, Homo sapiens
  misc_feature: HIJSMM301B2ODK.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattactgcaactcacttacaacgaccgacacttgcgtattcggcggcgggaccaagctgaccgtcctaggtcagcccaaggctgccccctcggt

SEQ ID NO: 550191 - DNA, 503 bp, Homo sapiens
  misc_feature: HIJSMM301BQOB1.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactagtggctgcaccatctgtcttctat

SEQ ID NO: 550192 - DNA, 486 bp, Homo sapiens; identical to SEQ ID NO: 535523
  misc_feature: HIJSMM301C77FJ.22.73.G07.1.454.light.4.raw

SEQ ID NO: 550193 - DNA, 501 bp, Homo sapiens
  misc_feature: HIJSMM301DUON3.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctcggtcactc

SEQ ID NO: 550194 - DNA, 493 bp, Homo sapiens
  misc_feature: HIJSMM301ESGSE.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcgagggacagaatttactctcaccatcagtagtctacagcctgaagatattgctacttattactgtcagcagagttaccgcgctcccatcactttcggccaagggacacgaccgcagattggacgaactgtggctgacaccatt

SEQ ID NO: 550195 - DNA, 489 bp, Homo sapiens; identical to SEQ ID NO: 536013
  misc_feature: HIJSMM301DW70U.26.23.C01.1.454.light.4.raw

SEQ ID NO: 550196 - DNA, 505 bp, Homo sapiens
  misc_feature: HIJSMM301A4X21.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 550197 - DNA, 479 bp, Homo sapiens; identical to SEQ ID NO: 535118
  misc_feature: HIJSMM301DQP9X.13.59.F04.1.454.light.4.raw

SEQ ID NO: 550198 - DNA, 503 bp, Homo sapiens; identical to SEQ ID NO: 541600
  misc_feature: HIJSMM301AJCO9.13.55.E11.1.454.light.4.raw

SEQ ID NO: 550199 - DNA, 497 bp, Homo sapiens
  misc_feature: HIJSMM301BW26L.51.80.H03.1.454.light.4.raw
cgatcgtatacacgaccggtgctcgatttagctgtgcgtcgaagggaaagggctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcactctgttccca

SEQ ID NO: 550200 - DNA, 499 bp, Homo sapiens; identical to SEQ ID NO: 536187
  misc_feature: HIJSMM301A5BF3.11.67.G01.1.454.light.4.raw

SEQ ID NO: 550201 - DNA, 494 bp, Homo sapiens; identical to SEQ ID NO: 541159
  misc_feature: HIJSMM301BYB91.15.59.F04.1.454.light.4.raw

SEQ ID NO: 550202 - DNA, 454 bp, Homo sapiens; identical to SEQ ID NO: 536449
  misc_feature: HIJSMM301EQZEM.18.78.H01.1.454.light.4.raw

SEQ ID NO: 550203 - DNA, 501 bp, Homo sapiens
  misc_feature: HIJSMM301C7JT8.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgtcggtccgagggaccgacgggaggaagacaaacgaactagtggcgtgcaccactctgtcttctatt

SEQ ID NO: 550204 - DNA, 493 bp, Homo sapiens
  misc_feature: HIJSMM301CPDDB.48.71.G05.1.454.light.4.raw
agtatacatacacgaccggtgctcgatttagtgtcgtcgcaagagagaggggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgatttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 550205 - DNA, 472 bp, Homo sapiens
  misc_feature: HIJSMM301AGBNQ.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 550206 - DNA, 503 bp, Homo sapiens; identical to SEQ ID NO: 535044
  misc_feature: HIJSMM301BW7RQ.19.78.H01.1.454.light.4.raw

SEQ ID NO: 550207 - DNA, 473 bp, Homo sapiens
  misc_feature: HIJSMM301BHBCH.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactgggtcccatcaaggttcagcggcagtggatctgcaacagacttcaatctcaccatcagcagcctgcagcctgaagattttgcaatttattactgtctgcaggattacacatacccctcgaacgttcggccaagggaccaaggtggaaatcaaacgaactagtgg

SEQ ID NO: 550208 - DNA, 506 bp, Homo sapiens
  misc_feature: HIJSMM301DFMOL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccgaaggaccgaacggtaggaaagtacaaacgaactagtggctgcaccatctgtcttcatcttccccg

SEQ ID NO: 550209 - DNA, 504 bp, Homo sapiens; identical to SEQ ID NO: 535495
  misc_feature: HIJSMM301A0Y7F.14.86.H09.1.454.light.4.raw

SEQ ID NO: 550210 - DNA, 495 bp, Homo sapiens; identical to SEQ ID NO: 537415
  misc_feature: HIJSMM301BV619.4.27.C05.1.454.light.4.raw

SEQ ID NO: 550211 - DNA, 494 bp, Homo sapiens; identical to SEQ ID NO: 534992
  misc_feature: HIJSMM301DZV4W.9.1.A01.1.454.light.4.raw

SEQ ID NO: 550212 - DNA, 491 bp, Homo sapiens
  misc_feature: HIJSMM301ASG4D.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttggaactttgtcgagggacgaacgctggagatcagacgaaactgtggcgtgcaccatctgtcttcta

SEQ ID NO: 550213 - DNA, 504 bp, Homo sapiens; identical to SEQ ID NO: 535561
  misc_feature: HIJSMM301DN0E4.4.57.F02.1.454.light.4.raw

SEQ ID NO: 550214 - DNA, 447 bp, Homo sapiens
  misc_feature: HIJSMM301AGDDG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacattggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 550215 - DNA, 498 bp, Homo sapiens; identical to SEQ ID NO: 535974
  misc_feature: HIJSMM301DOVT6.22.27.C05.1.454.light.4.raw

SEQ ID NO: 550216 - DNA, 497 bp, Homo sapiens; identical to SEQ ID NO: 545672
  misc_feature: HIJSMM301BB2Q3.2.49.E05.1.454.light.4.raw

SEQ ID NO: 550217 - DNA, 521 bp, Homo sapiens; identical to SEQ ID NO: 540400
  misc_feature: HIJSMM301EXV5A.27.23.C01.1.454.light.4.raw

SEQ ID NO: 550218 - DNA, 422 bp, Homo sapiens; identical to SEQ ID NO: 447881
  misc_feature: HIJSMM301EDT0C.9.34.D01.1.454.light.4.raw

SEQ ID NO: 550219 - DNA, 487 bp, Homo sapiens; identical to SEQ ID NO: 538190
  misc_feature: HIJSMM301AG5XI.47.70.G04.1.454.light.4.raw

SEQ ID NO: 550220 - DNA, 501 bp, Homo sapiens
  misc_feature: HIJSMM301EI13X.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaaacatgggatgacaatctgagcggttgggtgttcggcggagggaccaaactgaccgtcctaggtcagccc

SEQ ID NO: 550221 - DNA, 496 bp, Homo sapiens
  misc_feature: HIJSMM301AEBWB.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactagtggctgcaccatctgtctt

SEQ ID NO: 550222 - DNA, 487 bp, Homo sapiens
  misc_feature: HIJSMM301B6VFO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtaccccctcactttcggcggaggaccaaggcggagatcagacgaactgtggctgcaccatctgtcttcat

SEQ ID NO: 550223 - DNA, 492 bp, Homo sapiens
  misc_feature: HIJSMM301DLYP7.41.67.G01.1.454.light.4.raw
tctatactatcacgaccggtgctcgatttagagtatacatattgggtttggggagagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgggacagggggcgttttggtgttcggcggagggaccagactgaccgtcctgggtcagcccaaggctgccccctc

SEQ ID NO: 550224 - DNA, 504 bp, Homo sapiens; identical to SEQ ID NO: 541722
  misc_feature: HIJSMM301B7A17.48.34.D01.1.454.light.4.raw

SEQ ID NO: 550225 - DNA, 504 bp, Homo sapiens; identical to SEQ ID NO: 538940
  misc_feature: HIJSMM301C3DXO.2.35.D02.1.454.light.4.raw

SEQ ID NO: 550226 - DNA, 482 bp, Homo sapiens
  misc_feature: HIJSMM301DUIMT.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcgggcggagggaccaagctgaccgtcctaggtcaagcccaaggctcgccccctcggtcactctcgttcccaccctcctcgagtagtaca

SEQ ID NO: 550227 - DNA, 493 bp, Homo sapiens; identical to SEQ ID NO: 535745
  misc_feature: HIJSMM301EA10S.47.78.H01.1.454.light.4.raw

SEQ ID NO: 550228 - DNA, 519 bp, Homo sapiens; identical to SEQ ID NO: 541911
  misc_feature: HIJSMM301D8Q2Z.27.23.C01.1.454.light.4.raw

SEQ ID NO: 550229 - DNA, 444 bp, Homo sapiens; identical to SEQ ID NO: 535192
  misc_feature: HIJSMM301A8DE0.5.9.A09.1.454.light.4.raw

SEQ ID NO: 550230 - DNA, 488 bp, Homo sapiens; identical to SEQ ID NO: 545695
  misc_feature: HIJSMM301A9553.46.26.C04.1.454.light.4.raw

SEQ ID NO: 550231 - DNA, 477 bp, Homo sapiens
  misc_feature: HIJSMM301DBJ9C.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaggtggagatcaacgaactgtggctgcacc

SEQ ID NO: 550232 - DNA, 493 bp, Homo sapiens
  misc_feature: HIJSMM301AQE4J.43.61.F06.1.454.light.4.raw
tgtgagtagtcacgaccggtgctcgatttagctacgctctaagggaaaggggagagctgctcaattaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 550233 - DNA, 494 bp, Homo sapiens
  misc_feature: HIJSMM301AJKRC.41.49.E05.1.454.light.4.raw
tctatactatcacgaccggtgctcgatttagagcgactagcaacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaatttattactgtcagcagcgtatcaactggcctccgtggacgttcggccaagggaccaaggtggaaatcaaacgaactagtggctgcaccatct

SEQ ID NO: 550234 - DNA, 484 bp, Homo sapiens
  misc_feature: HIJSMM301DDBE3.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagccaaggctgccccctcggtcactctgttcccaccctcctctacgtgagct

SEQ ID NO: 550235 - DNA, 495 bp, Homo sapiens; identical to SEQ ID NO: 535821
  misc_feature: HIJSMM301CS3RB.3.31.C09.1.454.light.4.raw

SEQ ID NO: 550236 - DNA, 505 bp, Homo sapiens
  misc_feature: HIJSMM301D61PC.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcaggcgggtctgggacagatttcactctcaccatcagcagcctgcaggctgaagatgtggctagtttattactgtcagcaattatttttctatcctcgtggacgttcggccaagggaccagggtggaaatcagacgaactgtggctgcaccat

SEQ ID NO: 550237 - DNA, 485 bp, Homo sapiens; identical to SEQ ID NO: 536210
  misc_feature: HIJSMM301A7WTQ.43.54.E10.1.454.light.4.raw

SEQ ID NO: 550238 - DNA, 444 bp, Homo sapiens; identical to SEQ ID NO: 535192
  misc_feature: HIJSMM301BBR51.5.9.A09.1.454.light.4.raw

SEQ ID NO: 550239 - DNA, 515 bp, Homo sapiens
  misc_feature: HIJSMM301AQWSQ.43.67.G01.1.454.light.4.raw
tgtgagtagtcacgaccggtgctcgatttagagtatacatattgggtttgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtac

SEQ ID NO: 550240 - DNA, 490 bp, Homo sapiens
  misc_feature: HIJSMM301CFJA4.53.27.C05.1.454.light.4.raw
cgcgtatacacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctgccccccg

SEQ ID NO: 550241 - DNA, 495 bp, Homo sapiens; identical to SEQ ID NO: 536359
  misc_feature: HIJSMM301B6D41.48.4.A04.1.454.light.4.raw

SEQ ID NO: 550242 - DNA, 444 bp, Homo sapiens; identical to SEQ ID NO: 535027
  misc_feature: HIJSMM301BPEQ4.8.73.G07.1.454.light.4.raw

SEQ ID NO: 550243 - DNA, 509 bp, Homo sapiens
  misc_feature: HIJSMM301DW158.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaaggtggaggatgaagctgactactactgttactcaatagagaacagtgataattctgggtgttcggcggagggaccaaactgaccgtcctaggtcagcccaagctcgccccctcggtcacttcc

SEQ ID NO: 550244 - DNA, 492 bp, Homo sapiens; identical to SEQ ID NO: 536087
  misc_feature: HIJSMM301C9SO7.10.17.B06.1.454.light.4.raw

SEQ ID NO: 550245 - DNA, 447 bp, Homo sapiens; identical to SEQ ID NO: 535201
  misc_feature: HIJSMM301BKSUU.18.9.A09.1.454.light.4.raw

SEQ ID NO: 550246 - DNA, 507 bp, Homo sapiens; identical to SEQ ID NO: 535641
  misc_feature: HIJSMM301DEL18.10.88.H11.1.454.light.4.raw

SEQ ID NO: 550247 - DNA, 503 bp, Homo sapiens
  misc_feature: HIJSMM301E2XBW.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcggtgttcggtcggggacggacaagctcgaccgtcgtaggtcacgaccgagctcccgccccgtcgtctacttcg

SEQ ID NO: 550248 - DNA, 497 bp, Homo sapiens; identical to SEQ ID NO: 535740
  misc_feature: HIJSMM301D0TJ0.3.71.G05.1.454.light.4.raw

SEQ ID NO: 550249 - DNA, 482 bp, Homo sapiens
  misc_feature: HIJSMM301DH4UI.49.8.A08.1.454.light.4.raw
agtcgagagacacgaccggtgctcgatttagcatactctacaggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 550250 - DNA, 458 bp, Homo sapiens
  misc_feature: HIJSMM301CHZU6.49.85.H08.1.454.light.4.raw
agtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggaggggaccaagctgaccgt

SEQ ID NO: 550251 - DNA, 493 bp, Homo sapiens; identical to SEQ ID NO: 535084
  misc_feature: HIJSMM301C5RKJ.47.64.F09.1.454.light.4.raw

SEQ ID NO: 550252 - DNA, 485 bp, Homo sapiens; identical to SEQ ID NO: 536630
  misc_feature: HIJSMM301DJRDR.13.56.F01.1.454.light.4.raw

SEQ ID NO: 550253 - DNA, 508 bp, Homo sapiens
  misc_feature: HIJSMM301CABRV.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctcggtcactctcg

SEQ ID NO: 550254 - DNA, 494 bp, Homo sapiens
  misc_feature: HIJSMM301CDOBU.48.1.A01.1.454.light.4.raw
agtatacatacacgaccggtgctcgatttagacgtctcatcaggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaacgaactgtggctgcaccatctgtcttcatcttcccg

SEQ ID NO: 550255 - DNA, 495 bp, Homo sapiens
  misc_feature: HIJSMM301ELBYG.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgactgtggctgcacc

SEQ ID NO: 550256 - DNA, 486 bp, Homo sapiens; identical to SEQ ID NO: 535385
  misc_feature: HIJSMM301A5AJ6.19.71.G05.1.454.light.4.raw

SEQ ID NO: 550257 - DNA, 491 bp, Homo sapiens; identical to SEQ ID NO: 536211
  misc_feature: HIJSMM301C6GAE.16.53.E09.1.454.light.4.raw

SEQ ID NO: 550258 - DNA, 487 bp, Homo sapiens; identical to SEQ ID NO: 540557
  misc_feature: HIJSMM301AHETV.41.44.D11.1.454.light.4.raw

SEQ ID NO: 550259 - DNA, 489 bp, Homo sapiens; identical to SEQ ID NO: 535139
  misc_feature: HIJSMM301BI4MN.14.55.E11.1.454.light.4.raw

SEQ ID NO: 550260 - DNA, 505 bp, Homo sapiens
  misc_feature: HIJSMM301DN1PQ.48.38.D05.1.454.light.4.raw
agtatacatacacgaccggtgctcgatttagtatctgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatcctgtcttcatcttccccg

SEQ ID NO: 550261 - DNA, 509 bp, Homo sapiens
  misc_feature: HIJSMM301C58Z0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatacaaacgaactagtggcgtgcgaccatctgtcttcatcttccccg

SEQ ID NO: 550262 - DNA, 514 bp, Homo sapiens; identical to SEQ ID NO: 538515
  misc_feature: HIJSMM301EBZ9R.17.37.D04.1.454.light.4.raw

SEQ ID NO: 550263 - DNA, 493 bp, Homo sapiens
  misc_feature: HIJSMM301EYMH6.14.36.D03.1.454.light.4.raw
cgtctagtaccacgaccggtgctcgatttagctgcgtcacgatctctcttggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccgaaggtgaccgtcctaggtcagccc

SEQ ID NO: 550264 - DNA, 494 bp, Homo sapiens; identical to SEQ ID NO: 535680
  misc_feature: HIJSMM301AS7WM.16.78.H01.1.454.light.4.raw

SEQ ID NO: 550265 - DNA, 470 bp, Homo sapiens
  misc_feature: HIJSMM301BQDPB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccaaggtggacatcaacgaa

SEQ ID NO: 550266 - DNA, 505 bp, Homo sapiens
  misc_feature: HIJSMM301EE9PB.51.83.H06.1.454.light.4.raw
cgatcgtatacacgaccggtgctcgatttagatcacgtgcgtcgcgggcggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtaggaaatacaaacgaa

SEQ ID NO: 550267 - DNA, 486 bp, Homo sapiens; identical to SEQ ID NO: 535043
  misc_feature: HIJSMM301AG6ZA.46.35.D02.1.454.light.4.raw

SEQ ID NO: 550268 - DNA, 471 bp, Homo sapiens
  misc_feature: HIJSMM301CHU18.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgcat

SEQ ID NO: 550269 - DNA, 488 bp, Homo sapiens; identical to SEQ ID NO: 535990
  misc_feature: HIJSMM301BLXGX.11.28.C06.1.454.light.4.raw

SEQ ID NO: 550270 - DNA, 482 bp, Homo sapiens; identical to SEQ ID NO: 538815
  misc_feature: HIJSMM301B0RQ6.4.34.D01.1.454.light.4.raw

SEQ ID NO: 550271 - DNA, 460 bp, Homo sapiens; identical to SEQ ID NO: 536053
  misc_feature: HIJSMM301CCXI7.22.28.C06.1.454.light.4.raw

SEQ ID NO: 550272 - DNA, 470 bp, Homo sapiens; identical to SEQ ID NO: 535302
  misc_feature: HIJSMM301CC6ZE.13.76.G10.1.454.light.4.raw

SEQ ID NO: 550273 - DNA, 494 bp, Homo sapiens; identical to SEQ ID NO: 534994
  misc_feature: HIJSMM301CNEPM.27.78.H01.1.454.light.4.raw

SEQ ID NO: 550274 - DNA, 496 bp, Homo sapiens
  misc_feature: HIJSMM301AZU5K.8.24.C02.1.454.light.4.raw
ctcgcgtgtccacgaccggtgctcgatttagtacagatcgttagggaaagggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctg

SEQ ID NO: 550275 - DNA, 494 bp, Homo sapiens
  misc_feature: HIJSMM301AHRI0.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccc

SEQ ID NO: 550276 - DNA, 494 bp, Homo sapiens; identical to SEQ ID NO: 536974
  misc_feature: HIJSMM301DQHGA.16.86.H09.1.454.light.4.raw

SEQ ID NO: 550277 - DNA, 490 bp, Homo sapiens
  misc_feature: HIJSMM301BYZWN.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaacgaactgtggctgcaccatctgt

SEQ ID NO: 550278 - DNA, 476 bp, Homo sapiens; identical to SEQ ID NO: 537368
  misc_feature: HIJSMM301BXNGY.7.83.H06.1.454.light.4.raw

SEQ ID NO: 550279 - DNA, 512 bp, Homo sapiens
  misc_feature: HIJSMM301B0YXL.43.86.H09.1.454.light.4.raw
tgtgagtagtcacgaccggtgctcgatttagtgctatagacttgggtttggggtgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattacttgcatgcaaacttcacactggcctccgttcacttttggtccaggggaccgaaggtggaggatcaaacgaaactgtggctgcaccatcttcg

SEQ ID NO: 550280 - DNA, 487 bp, Homo sapiens; identical to SEQ ID NO: 536536
  misc_feature: HIJSMM301BYUIT.26.45.E01.1.454.light.4.raw

SEQ ID NO: 550281 - DNA, 470 bp, Homo sapiens; identical to SEQ ID NO: 536130
  misc_feature: HIJSMM301C8G91.7.81.H04.1.454.light.4.raw

SEQ ID NO: 550282 - DNA, 518 bp, Homo sapiens
  misc_feature: HIJSMM301BZVO2.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccacctcct

SEQ ID NO: 550283 - DNA, 440 bp, Homo sapiens; identical to SEQ ID NO: 537628
  misc_feature: HIJSMM301AY9GW.41.9.A09.1.454.light.4.raw

SEQ ID NO: 550284 - DNA, 493 bp, Homo sapiens; identical to SEQ ID NO: 535084
  misc_feature: HIJSMM301CJQRQ.47.64.F09.1.454.light.4.raw

SEQ ID NO: 550285 - DNA, 480 bp, Homo sapiens
  misc_feature: HIJSMM301CTG2T.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttcccccttcaccttcggccaagggacacgactggacattaaacgaactgtggctgcacc

SEQ ID NO: 550286 - DNA, 524 bp, Homo sapiens
  misc_feature: HIJSMM301AFO10.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtcgttcggcggggggaccgaacgactgaccgtcctacggtcagcccaacggctgccccctccggtcacctctcgttcccaccctcctcagacgtatca

SEQ ID NO: 550287 - DNA, 491 bp, Homo sapiens
  misc_feature: HIJSMM301D8DCC.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccaaggtgaccgtcctaggtcagccc

SEQ ID NO: 550288 - DNA, 502 bp, Homo sapiens
  misc_feature: HIJSMM301B3RWB.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaacgggacgacgactggagattaaacgaactgtggctgcaccatctgtcttcatcttcccg

SEQ ID NO: 550289 - DNA, 487 bp, Homo sapiens; identical to SEQ ID NO: 536206
  misc_feature: HIJSMM301CGO8F.47.38.D05.1.454.light.4.raw

SEQ ID NO: 550290 - DNA, 495 bp, Homo sapiens
  misc_feature: HIJSMM301CVT2U.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcaggtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 550291 - DNA, 509 bp, Homo sapiens; identical to SEQ ID NO: 541168
  misc_feature: HIJSMM301CP1L8.5.60.F05.1.454.light.4.raw

SEQ ID NO: 550292 - DNA, 484 bp, Homo sapiens; identical to SEQ ID NO: 535441
  misc_feature: HIJSMM301ALP64.26.60.F05.1.454.light.4.raw

SEQ ID NO: 550293 - DNA, 511 bp, Homo sapiens
  misc_feature: HIJSMM301BXWEB.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccacctcct

SEQ ID NO: 550294 - DNA, 496 bp, Homo sapiens; identical to SEQ ID NO: 539888
  misc_feature: HIJSMM301DRNPU.15.58.F03.1.454.light.4.raw

SEQ ID NO: 550295 - DNA, 485 bp, Homo sapiens; identical to SEQ ID NO: 535501
  misc_feature: HIJSMM301CDTR8.3.10.A10.1.454.light.4.raw

SEQ ID NO: 550296 - DNA, 460 bp, Homo sapiens; identical to SEQ ID NO: 537107
  misc_feature: HIJSMM301BZ1F2.22.28.C06.1.454.light.4.raw

SEQ ID NO: 550297 - DNA, 503 bp, Homo sapiens; identical to SEQ ID NO: 539976
  misc_feature: HIJSMM301DKTM8.47.55.E11.1.454.light.4.raw

SEQ ID NO: 550298 - DNA, 472 bp, Homo sapiens; identical to SEQ ID NO: 542432
  misc_feature: HIJSMM301D39JT.13.11.A11.1.454.light.4.raw

SEQ ID NO: 550299 - DNA, 471 bp, Homo sapiens
  misc_feature: HIJSMM301DNLXK.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctcggactgaagtgcatatgaagagaactgtgg

SEQ ID NO: 550300 - DNA, 497 bp, Homo sapiens
  misc_feature: HIJSMM301DNCUH.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccacctgaccatcaacaggtccggactgaagacgaggctgactattactgcttgtctggggatgaggacacattggtgttcggcggagggaccaagctgaccgtcctacgtcagcccaaggctgccccctcggtcactctgtt

SEQ ID NO: 550301 - DNA, 463 bp, Homo sapiens; identical to SEQ ID NO: 535008
  misc_feature: HIJSMM301A0AA7.10.9.A09.1.454.light.4.raw

SEQ ID NO: 550302 - DNA, 488 bp, Homo sapiens; identical to SEQ ID NO: 539612
  misc_feature: HIJSMM301BFFXF.3.55.E11.1.454.light.4.raw

SEQ ID NO: 550303 - DNA, 499 bp, Homo sapiens
  misc_feature: HIJSMM301AVQRY.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggct

SEQ ID NO: 550304 - DNA, 502 bp, Homo sapiens; identical to SEQ ID NO: 536253
  misc_feature: HIJSMM301C4ROY.21.22.B11.1.454.light.4.raw

SEQ ID NO: 550305 - DNA, 488 bp, Homo sapiens; identical to SEQ ID NO: 535990
  misc_feature: HIJSMM301BLSDI.11.28.C06.1.454.light.4.raw

SEQ ID NO: 550306 - DNA, 462 bp, Homo sapiens
  misc_feature: HIJSMM301BNP4D.49.9.A09.1.454.light.4.raw
agtcgagagacacgaccggtgctcgatttagcgagacgcgcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaa

SEQ ID NO: 550307 - DNA, 499 bp, Homo sapiens; identical to SEQ ID NO: 539754
  misc_feature: HIJSMM301E13WW.11.21.B10.1.454.light.4.raw

SEQ ID NO: 550308 - DNA, 476 bp, Homo sapiens
  misc_feature: HIJSMM301CYBA4.51.75.G09.1.454.light.4.raw
cgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggaggaccaagctgaccgtcc

SEQ ID NO: 550309 - DNA, 493 bp, Homo sapiens
  misc_feature: HIJSMM301C2977.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttggccaagggacacgactggagattaaaggaactgtggctgcaccatctgtcttcatcttccccg

SEQ ID NO: 550310 - DNA, 511 bp, Homo sapiens
  misc_feature: HIJSMM301CFH5X.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccact

SEQ ID NO: 550311 - DNA, 311 bp, Homo sapiens
  misc_feature: HIJSMM301CTE7Z.43.9.A09.1.454.light.4.raw
tgtgagtagtcacgaccggtgctcgatttagcgagacgcgcaggggatgtgggtccaggaggcacagctctgggaatctcaccatggcctggatccctctcctgctccccctcctcactctgcacaggctctgaggcctcctatgagctgacacagccaccctcggtgtcagtgtccctaggacagatggccaggatcacctgctctggagaagcattgaccaaaaaatatgcttattggtaccagcagaagccaggtcagcccaaggctgccccctcggtcactctgttcccacctcctcactactcaca

SEQ ID NO: 550312 - DNA, 506 bp, Homo sapiens
  misc_feature: HIJSMM301CIXX8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccgaaggtggaaagtcaaacgaactcgtggctgcaccatctgtcttcatccttccccg

SEQ ID NO: 550313 - DNA, 476 bp, Homo sapiens; identical to SEQ ID NO: 538611
  misc_feature: HIJSMM301CHPSR.7.81.H04.1.454.light.4.raw

SEQ ID NO: 550314 - DNA, 486 bp, Homo sapiens; identical to SEQ ID NO: 536261
  misc_feature: HIJSMM301CZQ6M.26.55.E11.1.454.light.4.raw

SEQ ID NO: 550315 - DNA, 478 bp, Homo sapiens
  misc_feature: HIJSMM301B9TN5.41.76.G10.1.454.light.4.raw
tctatactatcacgaccggtgctcgatttagtcactcatacagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgtttcggccaagggaccaaggtggacgatcaaacgaactgtggctgcacca

SEQ ID NO: 550316 - DNA, 509 bp, Homo sapiens
  misc_feature: HIJSMM301DYTER.17.87.H10.1.454.light.4.raw
cgtagactagcacgaccggtgctcgatttagcagtactgcgttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggtaggcaccaaggtgaccgtcctaggtcagcccaaggctgccccctcggtcta

SEQ ID NO: 550317 - DNA, 514 bp, Homo sapiens; identical to SEQ ID NO: 541418
  misc_feature: HIJSMM301A3RFZ.17.33.C11.1.454.light.4.raw

SEQ ID NO: 550318 - DNA, 505 bp, Homo sapiens
  misc_feature: HIJSMM301CIZQM.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcacatctgtcttcatccttcccgcctat

SEQ ID NO: 550319 - DNA, 447 bp, Homo sapiens; identical to SEQ ID NO: 535020
  misc_feature: HIJSMM301ERCX1.18.9.A09.1.454.light.4.raw

SEQ ID NO: 550320 - DNA, 495 bp, Homo sapiens; identical to SEQ ID NO: 535596
  misc_feature: HIJSMM301AWZSD.10.79.H02.1.454.light.4.raw

SEQ ID NO: 550321 - DNA, 454 bp, Homo sapiens
  misc_feature: HIJSMM301EW919.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaaggttccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 550322 - DNA, 497 bp, Homo sapiens
  misc_feature: HIJSMM301B2KLA.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttactcggtctacaacatgattaatttccctccgtggacgttcggccaagggaccaaggagcaaatcaaacgaactgtggctgcaccatctgtcttcatcttcccgccat

SEQ ID NO: 550323 - DNA, 494 bp, Homo sapiens; identical to SEQ ID NO: 534994
  misc_feature: HIJSMM301EBVXZ.27.78.H01.1.454.light.4.raw

SEQ ID NO: 550324 - DNA, 484 bp, Homo sapiens; identical to SEQ ID NO: 535400
  misc_feature: HIJSMM301CJPKJ.46.26.C04.1.454.light.4.raw

SEQ ID NO: 550325 - DNA, 505 bp, Homo sapiens; identical to SEQ ID NO: 535503
  misc_feature: HIJSMM301DBU6K.8.28.C06.1.454.light.4.raw

SEQ ID NO: 550326 - DNA, 517 bp, Homo sapiens
  misc_feature: HIJSMM301DPGTS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcacgcaaagcgggacccagaccctggagcctcagttggaagcagccgatccagcctgcggagcctgtggggcagggtcagcccaaggccaaccccactgtcactctcg

SEQ ID NO: 550327 - DNA, 490 bp, Homo sapiens; identical to SEQ ID NO: 542396
  misc_feature: HIJSMM301CJYKZ.16.53.E09.1.454.light.4.raw

SEQ ID NO: 550328 - DNA, 496 bp, Homo sapiens
  misc_feature: HIJSMM301ENUOV.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactc

SEQ ID NO: 550329 - DNA, 515 bp, Homo sapiens
  misc_feature: HIJSMM301EHE9N.48.66.F11.1.454.light.4.raw
agtatacatacacgaccggtgctcgatttagtcacgcgagaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtccactctcgttcccta

SEQ ID NO: 550330 - DNA, 487 bp, Homo sapiens; identical to SEQ ID NO: 536206
  misc_feature: HIJSMM301AGJDK.47.38.D05.1.454.light.4.raw

SEQ ID NO: 550331 - DNA, 475 bp, Homo sapiens
  misc_feature: HIJSMM301ALMKM.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtacggatatcaaacgaactagtggctgcaccatctgtcttcatcttcccgccat

SEQ ID NO: 550332 - DNA, 485 bp, Homo sapiens; identical to SEQ ID NO: 539041
  misc_feature: HIJSMM301EWZ7H.46.26.C04.1.454.light.4.raw

SEQ ID NO: 550333 - DNA, 506 bp, Homo sapiens
  misc_feature: HIJSMM301EK3SA.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaacgaactgtggctgcacatctgtcttcta

SEQ ID NO: 550334 - DNA, 483 bp, Homo sapiens
  misc_feature: HIJSMM301B881N.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaacgaactgtggctgcaccatctgtcttcatctttccgccatctgactagtctacg

SEQ ID NO: 550335 - DNA, 484 bp, Homo sapiens
  misc_feature: HIJSMM301BCK4X.4.1.A01.1.454.light.4.raw
  modified_base (414)..(414): a, c, t, g, unknown or other
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagcccaccctctcctgcagggccaatcagagtattggtcacagcttagcctggtaccagcagaaacctggccaggctcccggtctcctcatctctgctgcgtccatcagggccactggtatccctgcccaggttccgtggcagtgggtctgggacagagttcactctcaccatcagcagcctgcagtctgatgatgttgctagtttattactgtcatcaatntggtgaccggccacgttcggcaagggaccaaggtggaaatcaaacgactgtggctgcaccatcttgtctt

SEQ ID NO: 550336 - DNA, 461 bp, Homo sapiens
  misc_feature: HIJSMM301EOLOT.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggaagggaccaggctgaccgtcctaggtcagcccaaggctgccccctcggtcactctgttcccgccctcctcacgcgtatgt

SEQ ID NO: 550337 - DNA, 502 bp, Homo sapiens
  misc_feature: HIJSMM301BBS1P.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccaccctcctctgtcgagctctgc

SEQ ID NO: 550338 - DNA, 486 bp, Homo sapiens; identical to SEQ ID NO: 537617
  misc_feature: HIJSMM301D5RCR.10.53.E09.1.454.light.4.raw

SEQ ID NO: 550339 - DNA, 487 bp, Homo sapiens; identical to SEQ ID NO: 535583
  misc_feature: HIJSMM301CPIUG.22.73.G07.1.454.light.4.raw

SEQ ID NO: 550340 - DNA, 482 bp, Homo sapiens; identical to SEQ ID NO: 535352
  misc_feature: HIJSMM301ECNWM.16.81.H04.1.454.light.4.raw

SEQ ID NO: 550341 - DNA, 464 bp, Homo sapiens
  misc_feature: HIJSMM301BKUTC.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcatcctgcagcctgaagatgttgcaacttattactgtcaaaagaatagcgctgccccgctcagtttcggcggagggaccaaggtggagata

SEQ ID NO: 550342 - DNA, 505 bp, Homo sapiens; identical to SEQ ID NO: 536254
  misc_feature: HIJSMM301BPYAQ.7.71.G05.1.454.light.4.raw

SEQ ID NO: 550343 - DNA, 484 bp, Homo sapiens
  misc_feature: HIJSMM301DE7BY.40.81.H04.1.454.light.4.raw
tctagcgactcacgaccggtgctcgatttagtagtgtagattcgcggggtgactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaa

SEQ ID NO: 550344 - DNA, 434 bp, Homo sapiens; identical to SEQ ID NO: 535153
  misc_feature: HIJSMM301CAZ1Q.18.5.A05.1.454.light.4.raw

SEQ ID NO: 550345 - DNA, 487 bp, Homo sapiens
  misc_feature: HIJSMM301BHEQO.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgaactgtggctgcaccat

SEQ ID NO: 550346 - DNA, 494 bp, Homo sapiens
  misc_feature: HIJSMM301DFRR3.51.34.D01.1.454.light.4.raw
cgatcgtatacacgaccggtgctcgatttagatcgtctgtgttgggtttgggggagtcagtctcagtcgggacacagcatggacatgagggtccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttatattgtcaacaggcttacatcacccctctcactttcggcggagggaccaaggtggagatcaaacgaactgtggctgcaccatctgtcttcatt

SEQ ID NO: 550347 - DNA, 516 bp, Homo sapiens
  misc_feature: HIJSMM301AJU4V.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaagtacgaaacgaactagtggcgtgcaccactctgtcttctactcttcccgtcccact

SEQ ID NO: 550348 - DNA, 515 bp, Homo sapiens
  misc_feature: HIJSMM301BSBBI.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaaggctgaccgtcctaagtcagccaaggctgcccctcggtcactctcgttcccacctcctacg

SEQ ID NO: 550349 - DNA, 499 bp, Homo sapiens; identical to SEQ ID NO: 544841
  misc_feature: HIJSMM301C8V8C.19.10.A10.1.454.light.4.raw

SEQ ID NO: 550350 - DNA, 517 bp, Homo sapiens; identical to SEQ ID NO: 539607
  misc_feature: HIJSMM301C2F88.41.55.E11.1.454.light.4.raw

SEQ ID NO: 550351 - DNA, 508 bp, Homo sapiens
  misc_feature: HIJSMM301BCGZM.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggaacacgacctaggaggattaaaacg

SEQ ID NO: 550352 - DNA, 444 bp, Homo sapiens; identical to SEQ ID NO: 535027
  misc_feature: HIJSMM301CQJQR.8.73.G07.1.454.light.4.raw

SEQ ID NO: 550353 - DNA, 519 bp, Homo sapiens
  misc_feature: HIJSMM301CL3SM.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgt

SEQ ID NO: 550354 - DNA, 484 bp, Homo sapiens; identical to SEQ ID NO: 535400
  misc_feature: HIJSMM301E1BIC.46.26.C04.1.454.light.4.raw

SEQ ID NO: 550355 - DNA, 476 bp, Homo sapiens; identical to SEQ ID NO: 538611
  misc_feature: HIJSMM301BYJDQ.7.81.H04.1.454.light.4.raw

SEQ ID NO: 550356 - DNA, 487 bp, Homo sapiens
  misc_feature: HIJSMM301B1FJL.4.57.F02.1.454.light.4.raw
agcactgtagcacgaccggtgctcgatttagctcgatatagttgggtttgggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgca

SEQ ID NO: 550357 - DNA, 502 bp, Homo sapiens
  misc_feature: HIJSMM301EHTCO.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactagtggctgcaccatctgtcttcatcttcccg

SEQ ID NO: 550358 - DNA, 416 bp, Homo sapiens; identical to SEQ ID NO: 539343
  misc_feature: HIJSMM301DV64R.18.78.H01.1.454.light.4.raw

SEQ ID NO: 550359 - DNA, 502 bp, Homo sapiens; identical to SEQ ID NO: 536253
  misc_feature: HIJSMM301AFUBL.21.22.B11.1.454.light.4.raw

SEQ ID NO: 550360 - DNA, 489 bp, Homo sapiens
  misc_feature: HIJSMM301EFI8D.14.55.E11.1.454.light.4.raw
  modified_base (467)..(467): a, c, t, g, unknown or other
  modified_base (487)..(487): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactntggctgcaccatctgtcttnta

SEQ ID NO: 550361 - DNA, 494 bp, Homo sapiens; identical to SEQ ID NO: 534994
  misc_feature: HIJSMM301C1WCJ.27.78.H01.1.454.light.4.raw

SEQ ID NO: 550362 - DNA, 454 bp, Homo sapiens; identical to SEQ ID NO: 534964
  misc_feature: HIJSMM301B3KS8.19.86.H09.1.454.light.4.raw

SEQ ID NO: 550363 - DNA, 487 bp, Homo sapiens
  misc_feature: HIJSMM301AT0MO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggatatcagacgaa

SEQ ID NO: 550364 - DNA, 506 bp, Homo sapiens; identical to SEQ ID NO: 539926
  misc_feature: HIJSMM301BDC0W.5.24.C02.1.454.light.4.raw

SEQ ID NO: 550365 - DNA, 462 bp, Homo sapiens; identical to SEQ ID NO: 549716
  misc_feature: HIJSMM301CFK8Y.11.73.G07.1.454.light.4.raw

SEQ ID NO: 550366 - DNA, 508 bp, Homo sapiens
  misc_feature: HIJSMM301AH1SQ.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccgacggggaccgaacggtacgggaaagttacaaaacgaaacctaggtggcgttggcacccaa

SEQ ID NO: 550367 - DNA, 460 bp, Homo sapiens; identical to SEQ ID NO: 536053
  misc_feature: HIJSMM301B4GVJ.22.28.C06.1.454.light.4.raw

SEQ ID NO: 550368 - DNA, 493 bp, Homo sapiens; identical to SEQ ID NO: 538516
  misc_feature: HIJSMM301DR08O.11.81.H04.1.454.light.4.raw

SEQ ID NO: 550369 - DNA, 494 bp, Homo sapiens
  misc_feature: HIJSMM301B0WEU.10.72.G06.1.454.light.4.raw
catagtagtgcacgaccggtgctcgatttagctacgactgcaagggaaaggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccacgactcatcatttctgatgtcagtgatcggccctttgggatttctaatcgcttctctgtctccaagtctggcaacacggcttccctgaccatctccgggctccacgctgaggacgaggctcattattactgcagctcatatacacccagggggcactctcgtgatattcggcggagggacctggctgaccgtcctacgtcagccccaa

SEQ ID NO: 550370 - DNA, 550 bp, Homo sapiens
  misc_feature: HIJSMM301AQVH3.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggccccacctttcggtcccgtcgggaccgaaaacgtaggtagtaattacctaaaccgaaaaccgtagttgggtcgtcgcgacccaactcttgttctttccatttccttcccccgcctactctgaa

SEQ ID NO: 550371 - DNA, 502 bp, Homo sapiens
  misc_feature: HIJSMM301D1GXE.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgggaggaccaaactgaccgtcctaggtcagcccaaggctgccccctc

SEQ ID NO: 550372 - DNA, 497 bp, Homo sapiens
  misc_feature: HIJSMM301B99BP.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctctactttcggcggagggaccaaggtggagatacaaacgaactgtggctgcaccatctgtctt

SEQ ID NO: 550373 - DNA, 497 bp, Homo sapiens; identical to SEQ ID NO: 535286
  misc_feature: HIJSMM301A4M4X.18.59.F04.1.454.light.4.raw

SEQ ID NO: 550374 - DNA, 440 bp, Homo sapiens
  misc_feature: HIJSMM301CUXFB.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 550375 - DNA, 484 bp, Homo sapiens; identical to SEQ ID NO: 535400
  misc_feature: HIJSMM301DECA1.46.26.C04.1.454.light.4.raw

SEQ ID NO: 550376 - DNA, 495 bp, Homo sapiens
  misc_feature: HIJSMM301BGWHK.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcactcttcg

SEQ ID NO: 550377 - DNA, 454 bp, Homo sapiens; identical to SEQ ID NO: 536347
  misc_feature: HIJSMM301CJW7U.19.86.H09.1.454.light.4.raw

SEQ ID NO: 550378 - DNA, 512 bp, Homo sapiens
  misc_feature: HIJSMM301BO2KW.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctccccacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacct

SEQ ID NO: 550379 - DNA, 503 bp, Homo sapiens
  misc_feature: HIJSMM301C7AJY.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatccaccagcctgcagcctgaagattttgcaacttactattgtcaacaggctgacaggttcccgctgactttcggcggagggaccaaggtagagatacaaaggaactgtggctgcaccatctgtcttcatcttcccgccta

SEQ ID NO: 550380 - DNA, 508 bp, Homo sapiens
  misc_feature: HIJSMM301CAVJS.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccg

SEQ ID NO: 550381 - DNA, 494 bp, Homo sapiens; identical to SEQ ID NO: 534992
  misc_feature: HIJSMM301C5MQ6.9.1.A01.1.454.light.4.raw

SEQ ID NO: 550382 - DNA, 510 bp, Homo sapiens; identical to SEQ ID NO: 538767
  misc_feature: HIJSMM301A6IFV.17.28.C06.1.454.light.4.raw

SEQ ID NO: 550383 - DNA, 483 bp, Homo sapiens
  misc_feature: HIJSMM301A8U5K.48.81.H04.1.454.light.4.raw
agtatacatacacgaccggtgctcgatttagtagtgtagattcgcgggggctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaactgtggctgcaccat

SEQ ID NO: 550384 - DNA, 484 bp, Homo sapiens
  misc_feature: HIJSMM301D1ZL9.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaa

SEQ ID NO: 550385 - DNA, 463 bp, Homo sapiens; identical to SEQ ID NO: 535062
  misc_feature: HIJSMM301AODXI.11.73.G07.1.454.light.4.raw

SEQ ID NO: 550386 - DNA, 497 bp, Homo sapiens; identical to SEQ ID NO: 537288
  misc_feature: HIJSMM301BJQNA.15.25.C03.1.454.light.4.raw

SEQ ID NO: 550387 - DNA, 486 bp, Homo sapiens
  misc_feature: HIJSMM301EI5QD.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttaatcgggtgttcggcggagggaccaaagctgaccgtcctaggtcagcccaaggctgccccctcggtca

SEQ ID NO: 550388 - DNA, 434 bp, Homo sapiens; identical to SEQ ID NO: 535153
  misc_feature: HIJSMM301ATEIY.18.5.A05.1.454.light.4.raw

SEQ ID NO: 550389 - DNA, 501 bp, Homo sapiens
  misc_feature: HIJSMM301E2AQK.40.53.E09.1.454.light.4.raw
tctagcgactcacgaccggtgctcgatttagagagagtgtgttgggtttggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccgaagctgaccgtcctaagtcagcccaac

SEQ ID NO: 550390 - DNA, 497 bp, Homo sapiens
  misc_feature: HIJSMM301CIC6J.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcgaaacgaactagtggctggcaccatctgtcttcatcttcccgt

SEQ ID NO: 550391 - DNA, 503 bp, Homo sapiens; identical to SEQ ID NO: 536834
  misc_feature: HIJSMM301BW3ER.2.35.D02.1.454.light.4.raw

SEQ ID NO: 550392 - DNA, 495 bp, Homo sapiens; identical to SEQ ID NO: 535486
  misc_feature: HIJSMM301AUWLM.26.72.G06.1.454.light.4.raw

SEQ ID NO: 550393 - DNA, 500 bp, Homo sapiens; identical to SEQ ID NO: 542309
  misc_feature: HIJSMM301BHBA6.12.86.H09.1.454.light.4.raw

SEQ ID NO: 550394 - DNA, 503 bp, Homo sapiens; identical to SEQ ID NO: 535044
  misc_feature: HIJSMM301BMGV0.19.78.H01.1.454.light.4.raw

SEQ ID NO: 550395 - DNA, 500 bp, Homo sapiens
  misc_feature: HIJSMM301CKHOF.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccacctcctcgctacgtaga

SEQ ID NO: 550396 - DNA, 460 bp, Homo sapiens
  misc_feature: HIJSMM301ADMMZ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcaactcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 550397 - DNA, 484 bp, Homo sapiens; identical to SEQ ID NO: 535400
  misc_feature: HIJSMM301DYBFA.46.26.C04.1.454.light.4.raw

SEQ ID NO: 550398 - DNA, 512 bp, Homo sapiens; identical to SEQ ID NO: 541402
  misc_feature: HIJSMM301EU27G.43.19.B08.1.454.light.4.raw

SEQ ID NO: 550399 - DNA, 496 bp, Homo sapiens; identical to SEQ ID NO: 537681
  misc_feature: HIJSMM301E1KKC.40.23.C01.1.454.light.4.raw

SEQ ID NO: 550400 - DNA, 503 bp, Homo sapiens
  misc_feature: HIJSMM301D5GGM.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcgggcgggggaccaaggtggagttcaaacgaactggtggctgcaccatctgtcttcatcttcccg

SEQ ID NO: 550401 - DNA, 496 bp, Homo sapiens; identical to SEQ ID NO: 537925
  misc_feature: HIJSMM301AS7U1.22.14.B03.1.454.light.4.raw

SEQ ID NO: 550402 - DNA, 444 bp, Homo sapiens; identical to SEQ ID NO: 535192
  misc_feature: HIJSMM301CQU3Z.5.9.A09.1.454.light.4.raw

SEQ ID NO: 550403 - DNA, 491 bp, Homo sapiens; identical to SEQ ID NO: 535294
  misc_feature: HIJSMM301CPBGA.16.68.G02.1.454.light.4.raw

SEQ ID NO: 550404 - DNA, 490 bp, Homo sapiens
  misc_feature: HIJSMM301EDZLO.51.37.D04.1.454.light.4.raw
cgatcgtatacacgaccggtgctcgatttagtagcatactgttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatggtgcatccagcagggccgctggcatcccagacaggttcagtggcagtgggtctgggacagacttcagtctcaccatcagcggactggagcctgaagattttgcagtgtattactgtcagcaccatggtagctcatcccggtacacttttggccgggggaccaagctggagatcaaacgaactgtggctgcaccat

SEQ ID NO: 550405 - DNA, 497 bp, Homo sapiens; identical to SEQ ID NO: 536376
  misc_feature: HIJSMM301CGHFP.22.9.A09.1.454.light.4.raw

SEQ ID NO: 550406 - DNA, 494 bp, Homo sapiens
  misc_feature: HIJSMM301EM8N8.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttggccaagggacacgactggaaattaaacgaactgtggctgcaccatctgtcttcatcttcccgcc

SEQ ID NO: 550407 - DNA, 501 bp, Homo sapiens
  misc_feature: HIJSMM301CIJ9F.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtctaggtcagcccaaggctgccccctc

SEQ ID NO: 550408 - DNA, 484 bp, Homo sapiens
  misc_feature: HIJSMM301AM26Z.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctggacgttcggccaagggaccaaggtggaaatacaacgaaactgtggctgcaccatcctgtcttcta

SEQ ID NO: 550409 - DNA, 505 bp, Homo sapiens
  misc_feature: HIJSMM301CSEAF.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 550410 - DNA, 485 bp, Homo sapiens
  misc_feature: HIJSMM301EQWBL.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtca

SEQ ID NO: 550411 - DNA, 489 bp, Homo sapiens
  misc_feature: HIJSMM301CI4X5.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaataggggtcccaatcaaggttcagtggaagtggatctgggacgtattttactttctaccatcatcaacctgcagcctgaggatattgcaacatattactgtcaacaatatgataatctaccactcacttcggtcggagggaccgaccggtggagatcaaacgaactagtggctgcaccatctgtt

SEQ ID NO: 550412 - DNA, 491 bp, Homo sapiens
  misc_feature: HIJSMM301CF6C8.26.55.E11.1.454.light.4.raw
agactatactcacgaccggtgctcgatttagcactcgcacgttgggtttgggggcaggagtcagtctcagtcaggacacagcatggacatgcgggtcccctctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtccccccccacaaatttcagtggcagtggatctgggacagatttcactctcagcattaataatctgcaacctgaggattttgcaacttactactgtcaacagagttacacggcccccctatacttttggccaggggaccaagctggagatcacaggaactgtggctgcacc

SEQ ID NO: 550413 - DNA, 488 bp, Homo sapiens
  misc_feature: HIJSMM301EP529.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctggacgttcggccaagggaccaaggtggaaatcaaacgaactagtggctgcaccatctgtcttcat

SEQ ID NO: 550414 - DNA, 487 bp, Homo sapiens; identical to SEQ ID NO: 535863
  misc_feature: HIJSMM301BN0LC.19.71.G05.1.454.light.4.raw

SEQ ID NO: 550415 - DNA, 490 bp, Homo sapiens
  misc_feature: HIJSMM301BD8UE.47.78.H01.1.454.light.4.raw
  modified_base (466)..(466): a, c, t, g, unknown or other
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggttgttctccatgcaaggtacacactggccttttggccaggggaccaacctggagatcaaatnaactgtggctgcaccatctgtctt

SEQ ID NO: 550416 - DNA, 504 bp, Homo sapiens; identical to SEQ ID NO: 539083
  misc_feature: HIJSMM301DPANY.8.19.B08.1.454.light.4.raw

SEQ ID NO: 550417 - DNA, 483 bp, Homo sapiens
  misc_feature: HIJSMM301DXG2G.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaactaaacgaactgtggctgcacca

SEQ ID NO: 550418 - DNA, 497 bp, Homo sapiens
  misc_feature: HIJSMM301D1A6M.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctcgggaccgaaagtggagtttctagacgaactgtggctgcaccatctgtcttcta

SEQ ID NO: 550419 - DNA, 487 bp, Homo sapiens
  misc_feature: HIJSMM301CRE0G.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccgaagggaccaaggtggaaatcaaacgaactgtggctgca

SEQ ID NO: 550420 - DNA, 511 bp, Homo sapiens; identical to SEQ ID NO: 549837
  misc_feature: HIJSMM301BDO5W.15.34.D01.1.454.light.4.raw

SEQ ID NO: 550421 - DNA, 478 bp, Homo sapiens
  misc_feature: HIJSMM301CM9HF.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattgggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggcctatggatgaggctgactattactgtcaggcgtgggacagcaacactgtggtattcggcggagggaccaagctgaccgtcctaggtcagcccaagg

SEQ ID NO: 550422 - DNA, 518 bp, Homo sapiens
  misc_feature: HIJSMM301BQKJ8.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccccctcctcctacg

SEQ ID NO: 550423 - DNA, 484 bp, Homo sapiens; identical to SEQ ID NO: 547458
  misc_feature: HIJSMM301CSSG7.15.1.A01.1.454.light.4.raw

SEQ ID NO: 550424 - DNA, 486 bp, Homo sapiens; identical to SEQ ID NO: 535043
  misc_feature: HIJSMM301EZ57W.46.35.D02.1.454.light.4.raw

SEQ ID NO: 550425 - DNA, 377 bp, Homo sapiens; identical to SEQ ID NO: 536071
  misc_feature: HIJSMM301BSZSF.40.9.A09.1.454.light.4.raw

SEQ ID NO: 550426 - DNA, 502 bp, Homo sapiens; identical to SEQ ID NO: 540196
  misc_feature: HIJSMM301ANEBZ.40.45.E01.1.454.light.4.raw

SEQ ID NO: 550427 - DNA, 512 bp, Homo sapiens
  misc_feature: HIJSMM301BYO7D.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaaggtaggaagtacaacgaacgtagtggcgtgcaccactctcgtcttctactcttcccgtccact

SEQ ID NO: 550428 - DNA, 504 bp, Homo sapiens
  misc_feature: HIJSMM301A0KKB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggccaagggaccaaggtggaaatacaaacgaactagtggctgcaccatctgtcttcatcttccccg

SEQ ID NO: 550429 - DNA, 507 bp, Homo sapiens
  misc_feature: HIJSMM301AGKDA.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcggggtgttcggcggagggaccaagctgaccgtcctaagtcagcccaaggctgccccctcggtcactctcg

SEQ ID NO: 550430 - DNA, 471 bp, Homo sapiens
  misc_feature: HIJSMM301DYNS1.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaataccctccatacacttttggccagggaccaagctggagatcagaacg

SEQ ID NO: 550431 - DNA, 508 bp, Homo sapiens; identical to SEQ ID NO: 536388
  misc_feature: HIJSMM301C7XYB.11.57.F02.1.454.light.4.raw

SEQ ID NO: 550432 - DNA, 520 bp, Homo sapiens
  misc_feature: HIJSMM301B9MJB.27.23.C01.1.454.light.4.raw
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccnccct

SEQ ID NO: 550433 - DNA, 488 bp, Homo sapiens; identical to SEQ ID NO: 537124
  misc_feature: HIJSMM301ANFDV.11.25.C03.1.454.light.4.raw

SEQ ID NO: 550434 - DNA, 493 bp, Homo sapiens
  misc_feature: HIJSMM301EADY6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagtagtatcataggtcaaacaccttcggccaagggacacgactggagattaaaggaactgtggctgcaccatctgtcttcatcttcccg

SEQ ID NO: 550435 - DNA, 416 bp, Homo sapiens; identical to SEQ ID NO: 545902
  misc_feature: HIJSMM301ECPQD.18.78.H01.1.454.light.4.raw

SEQ ID NO: 550436 - DNA, 495 bp, Homo sapiens; identical to SEQ ID NO: 535964
  misc_feature: HIJSMM301AT2MV.16.10.A10.1.454.light.4.raw

SEQ ID NO: 550437 - DNA, 486 bp, Homo sapiens
  misc_feature: HIJSMM301CULJV.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaacgaactgtggctgcaccatctgtt

SEQ ID NO: 550438 - DNA, 511 bp, Homo sapiens
  misc_feature: HIJSMM301A3DN6.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 550439 - DNA, 504 bp, Homo sapiens; identical to SEQ ID NO: 535561
  misc_feature: HIJSMM301AKBL5.4.57.F02.1.454.light.4.raw

SEQ ID NO: 550440 - DNA, 483 bp, Homo sapiens
  misc_feature: HIJSMM301A7Z6E.51.60.F05.1.454.light.4.raw
cgatcgtatacacgaccggtgctcgatttagtacgtcatcagggaaaggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 550441 - DNA, 490 bp, Homo sapiens
  misc_feature: HIJSMM301AGX6F.3.10.A10.1.454.light.4.raw
  modified_base (255)..(255): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccnggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccgaggtcaccgtccctaggtcagcccaacggccaaccccca

SEQ ID NO: 550442 - DNA, 479 bp, Homo sapiens; identical to SEQ ID NO: 536050
  misc_feature: HIJSMM301C2Z5C.5.73.G07.1.454.light.4.raw

SEQ ID NO: 550443 - DNA, 489 bp, Homo sapiens; identical to SEQ ID NO: 535091
  misc_feature: HIJSMM301A9Z26.47.36.D03.1.454.light.4.raw

SEQ ID NO: 550444 - DNA, 507 bp, Homo sapiens
  misc_feature: HIJSMM301A4V1Q.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccatctgtccttcactcttccccg

SEQ ID NO: 550445 - DNA, 522 bp, Homo sapiens
  misc_feature: HIJSMM301ANO3T.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccgtcctaggtcagcccaaggctgccccctcggtcactctgttcccaccct

SEQ ID NO: 550446 - DNA, 481 bp, Homo sapiens; identical to SEQ ID NO: 535410
  misc_feature: HIJSMM301DDJH6.41.68.G02.1.454.light.4.raw

SEQ ID NO: 550447 - DNA, 486 bp, Homo sapiens; identical to SEQ ID NO: 537583
  misc_feature: HIJSMM301AST7L.17.25.C03.1.454.light.4.raw

SEQ ID NO: 550448 - DNA, 493 bp, Homo sapiens; identical to SEQ ID NO: 535047
  misc_feature: HIJSMM301DWA31.16.53.E09.1.454.light.4.raw

SEQ ID NO: 550449 - DNA, 489 bp, Homo sapiens
  misc_feature: HIJSMM301E0L97.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccctcactttcggcggagggaccaaggcggagatccagacgaactgtggctgcaccatctgtcttcta

SEQ ID NO: 550450 - DNA, 494 bp, Homo sapiens; identical to SEQ ID NO: 535828
  misc_feature: HIJSMM301BLSLB.3.36.D03.1.454.light.4.raw

SEQ ID NO: 550451 - DNA, 500 bp, Homo sapiens
  misc_feature: HIJSMM301CHD0P.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcgccgtcggaccgaagtagtggtagtatactaaacgaaacctaagttaggccgttggcaccaactctgtt

SEQ ID NO: 550452 - DNA, 473 bp, Homo sapiens; identical to SEQ ID NO: 541472
  misc_feature: HIJSMM301CC6HR.5.12.B01.1.454.light.4.raw

SEQ ID NO: 550453 - DNA, 494 bp, Homo sapiens; identical to SEQ ID NO: 534992
  misc_feature: HIJSMM301B58VP.9.1.A01.1.454.light.4.raw

SEQ ID NO: 550454 - DNA, 489 bp, Homo sapiens
  misc_feature: HIJSMM301CTV1A.19.71.G05.1.454.light.4.raw
tactctcgtgcacgaccggtgctcgatttagtgtcgtcgcaagagagaggggggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaactgtgg

SEQ ID NO: 550455 - DNA, 496 bp, Homo sapiens; identical to SEQ ID NO: 535109
  misc_feature: HIJSMM301CMGH9.16.78.H01.1.454.light.4.raw

SEQ ID NO: 550456 - DNA, 464 bp, Homo sapiens; identical to SEQ ID NO: 536640
  misc_feature: HIJSMM301ED9M6.26.78.H01.1.454.light.4.raw

SEQ ID NO: 550457 - DNA, 503 bp, Homo sapiens
  misc_feature: HIJSMM301CYVSY.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggcctgggaccaaagtggatatcaaacgaactgtggctgcaccatctgtctt

SEQ ID NO: 550458 - DNA, 507 bp, Homo sapiens
  misc_feature: HIJSMM301CJUPX.51.21.B10.1.454.light.4.raw
cgatcgtatacacgaccggtgctcgatttagtgtcgtcgcaagggggaagcagagttctggggtgtctccaccatggcctggacccctctctggctcactctcctcactctttgcataggttctgtggtttcttctgagttgactcaggaccctgctgtgtctgtggccttgggacagacagtcaggatcacatgccagggagacagcctcagaagtttttatgcaaactggtaccaacagaggccacgacagccccctacacttgtcatctatggtgaaaaaatcggccctcagggatcccagaccgattctctgcctccagctcaggaaacacagcttccttgatcatcgctggggctcaggcggaagatgaggctgactattactgtcactcccgggacagcagtagtcaccatttggaactattcggcggagggaccaagctgaccgtcctaggtcagcccaaggctgccccctcggtcactctgttcccgccctcctctcgt

SEQ ID NO: 550459 - DNA, 445 bp, Homo sapiens; identical to SEQ ID NO: 538567
  misc_feature: HIJSMM301CZG72.5.9.A09.1.454.light.4.raw

SEQ ID NO: 550460 - DNA, 484 bp, Homo sapiens; identical to SEQ ID NO: 535400
  misc_feature: HIJSMM301AO3RM.46.26.C04.1.454.light.4.raw

SEQ ID NO: 550461 - DNA, 487 bp, Homo sapiens; identical to SEQ ID NO: 541729
  misc_feature: HIJSMM301C288G.40.83.H06.1.454.light.4.raw

SEQ ID NO: 550462 - DNA, 498 bp, Homo sapiens; identical to SEQ ID NO: 547576
  misc_feature: HIJSMM301EHE6G.12.37.D04.1.454.light.4.raw

SEQ ID NO: 550463 - DNA, 490 bp, Homo sapiens; identical to SEQ ID NO: 538273
  misc_feature: HIJSMM301DCHI8.16.73.G07.1.454.light.4.raw

SEQ ID NO: 550464 - DNA, 482 bp, Homo sapiens
  misc_feature: HIJSMM301CQEX4.13.50.E06.1.454.light.4.raw
tcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaactgtggctgcacc

SEQ ID NO: 550465 - DNA, 487 bp, Homo sapiens; identical to SEQ ID NO: 536536
  misc_feature: HIJSMM301EE8MV.26.45.E01.1.454.light.4.raw

SEQ ID NO: 550466 - DNA, 522 bp, Homo sapiens
  misc_feature: HIJSMM301BW7G3.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactttgttcccaccctcctca

SEQ ID NO: 550467 - DNA, 493 bp, Homo sapiens; identical to SEQ ID NO: 536769
  misc_feature: HIJSMM301CRYDH.19.83.H06.1.454.light.4.raw

SEQ ID NO: 550468 - DNA, 489 bp, Homo sapiens
  misc_feature: HIJSMM301D5HHI.26.23.C01.1.454.light.4.raw
  modified_base (486)..(486): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatcngtt

SEQ ID NO: 550469 - DNA, 517 bp, Homo sapiens
  misc_feature: HIJSMM301D5VCG.41.19.B08.1.454.light.4.raw
tctatactatcacgaccggtgctcgatttagtgagtcagtaagggggctggggtctcaggaggcagcgctctcgggacgtctccaccatggcatgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccct

SEQ ID NO: 550470 - DNA, 506 bp, Homo sapiens
  misc_feature: HIJSMM301AVIUC.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctcccctgtccatcagtggactccggtctgaggatgaggctgactactattgttcaggatgggattacagcctaccatgctcggctgttcggcggagggaccaaactgaccgtcttaggtcagcccaaggctcgtccccccg

SEQ ID NO: 550471 - DNA, 505 bp, Homo sapiens; identical to SEQ ID NO: 536254
  misc_feature: HIJSMM301B5QGU.7.71.G05.1.454.light.4.raw

SEQ ID NO: 550472 - DNA, 483 bp, Homo sapiens
  misc_feature: HIJSMM301B01JT.49.83.H06.1.454.light.4.raw
agtcgagagacacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccat

SEQ ID NO: 550473 - DNA, 492 bp, Homo sapiens
  misc_feature: HIJSMM301ED6KP.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcatgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcaatttattactgtcaacaatgtggtcagtggcctcgaacgttcggcccacgggaccacagtggatatcaggcgaacgtgtggctgcaccatctgtt

SEQ ID NO: 550474 - DNA, 464 bp, Homo sapiens; identical to SEQ ID NO: 536640
  misc_feature: HIJSMM301ATN5H.26.78.H01.1.454.light.4.raw

SEQ ID NO: 550475 - DNA, 503 bp, Homo sapiens; identical to SEQ ID NO: 536435
  misc_feature: HIJSMM301CLZYK.21.22.B11.1.454.light.4.raw

SEQ ID NO: 550476 - DNA, 521 bp, Homo sapiens; identical to SEQ ID NO: 539470
  misc_feature: HIJSMM301BZ056.27.23.C01.1.454.light.4.raw

SEQ ID NO: 550477 - DNA, 506 bp, Homo sapiens
  misc_feature: HIJSMM301C759W.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggtttcggcggtggaccaagctgaccgtctaagtcagcccaaggctgccccctcggtcactctgtt

SEQ ID NO: 550478 - DNA, 495 bp, Homo sapiens; identical to SEQ ID NO: 542410
  misc_feature: HIJSMM301AXJ6G.26.12.B01.1.454.light.4.raw

SEQ ID NO: 550479 - DNA, 468 bp, Homo sapiens
  misc_feature: HIJSMM301AYQOI.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcatcctgcagcctgaagatgttgcaacttattactgtcaaaagaatagcgctgccccgctcagtttcggcggagggaccaaggtggagataacc

SEQ ID NO: 550480 - DNA, 481 bp, Homo sapiens; identical to SEQ ID NO: 536255
  misc_feature: HIJSMM301A1MCU.10.53.E09.1.454.light.4.raw

SEQ ID NO: 550481 - DNA, 504 bp, Homo sapiens
  misc_feature: HIJSMM301AEVTP.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggatccaagtctggcaacacggcctccctgaccgtctctgggctccagactgaggatgaggctgattattactgcagctcatattcaggcagcaacagggtattcgggcggagggaccaagttgaccgtcctaggtcagcccaaggctgccccctcggtcactctgtt

SEQ ID NO: 550482 - DNA, 490 bp, Homo sapiens; identical to SEQ ID NO: 535526
  misc_feature: HIJSMM301BOF84.26.78.H01.1.454.light.4.raw

SEQ ID NO: 550483 - DNA, 509 bp, Homo sapiens
  misc_feature: HIJSMM301D71PL.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttctcgccctcct

SEQ ID NO: 550484 - DNA, 434 bp, Homo sapiens; identical to SEQ ID NO: 535153
  misc_feature: HIJSMM301C3LRQ.18.5.A05.1.454.light.4.raw

SEQ ID NO: 550485 - DNA, 473 bp, Homo sapiens; identical to SEQ ID NO: 536488
  misc_feature: HIJSMM301AIOQI.12.49.E05.1.454.light.4.raw

SEQ ID NO: 550486 - DNA, 483 bp, Homo sapiens
  misc_feature: HIJSMM301BN62Q.49.34.D01.1.454.light.4.raw
agtcgagagacacgaccggtgctcgatttagatcgtctgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccat

SEQ ID NO: 550487 - DNA, 494 bp, Homo sapiens; identical to SEQ ID NO: 534994
  misc_feature: HIJSMM301DG8VH.27.78.H01.1.454.light.4.raw

SEQ ID NO: 550488 - DNA, 503 bp, Homo sapiens
  misc_feature: HIJSMM301ETV2X.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggccaagctgaccgtcctgggtcagcccaaggctgccccctcggtcact

SEQ ID NO: 550489 - DNA, 447 bp, Homo sapiens; identical to SEQ ID NO: 535201
  misc_feature: HIJSMM301ATLAK.18.9.A09.1.454.light.4.raw

SEQ ID NO: 550490 - DNA, 506 bp, Homo sapiens
  misc_feature: HIJSMM301DS3EG.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaacggccaaccccactgtcta

SEQ ID NO: 550491 - DNA, 484 bp, Homo sapiens; identical to SEQ ID NO: 535400
  misc_feature: HIJSMM301CLDS9.46.26.C04.1.454.light.4.raw

SEQ ID NO: 550492 - DNA, 499 bp, Homo sapiens
  misc_feature: HIJSMM301CERY3.43.66.F11.1.454.light.4.raw
tgtgagtagtcacgaccggtgctcgatttagtcacgcgagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 550493 - DNA, 490 bp, Homo sapiens
  misc_feature: HIJSMM301EPE5G.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcagaccccg

SEQ ID NO: 550494 - DNA, 480 bp, Homo sapiens
  misc_feature: HIJSMM301DW6DW.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggtttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggacc

SEQ ID NO: 550495 - DNA, 490 bp, Homo sapiens; identical to SEQ ID NO: 541974
  misc_feature: HIJSMM301A8P30.22.65.F10.1.454.light.4.raw

SEQ ID NO: 550496 - DNA, 483 bp, Homo sapiens
  misc_feature: HIJSMM301A978Q.41.78.H01.1.454.light.4.raw
tctatactatcacgaccggtgctcgatttagtgtgagtagtttgggtttgggtgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaa

SEQ ID NO: 550497 - DNA, 492 bp, Homo sapiens; identical to SEQ ID NO: 535126
  misc_feature: HIJSMM301EB4FU.18.11.A11.1.454.light.4.raw

SEQ ID NO: 550498 - DNA, 447 bp, Homo sapiens; identical to SEQ ID NO: 535020
  misc_feature: HIJSMM301BUX1I.18.9.A09.1.454.light.4.raw

SEQ ID NO: 550499 - DNA, 452 bp, Homo sapiens
  misc_feature: HIJSMM301CWLRL.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctgcccctcggtcactctgttcccgccctcctccacgagagta

SEQ ID NO: 550500 - DNA, 491 bp, Homo sapiens
  misc_feature: HIJSMM301ETO0H.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcacaacctgcaggctgaagatgtggcagtttattactgtcagcaatactatagtcctcctctcacgttcggcggagggaccaaggtggagatcaaacgaactgtggctgcaccatctgtcttcatcttcccgccat

SEQ ID NO: 550501 - DNA, 338 bp, Homo sapiens
  misc_feature: HIJSMM301DSHEV.49.68.G02.1.454.light.4.raw
agtcgagagacacgaccggtgctcgatttagtcgatagtgaagggaaagggggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgcccctcggtcactctgttcccgccctcctctctctcgact

SEQ ID NO: 550502 - DNA, 509 bp, Homo sapiens; identical to SEQ ID NO: 541829
  misc_feature: HIJSMM301EIPUN.17.28.C06.1.454.light.4.raw

SEQ ID NO: 550503 - DNA, 462 bp, Homo sapiens
  misc_feature: HIJSMM301ASXM7.49.8.A08.1.454.light.4.raw
agtcgagagacacgaccggtgctcgatttagcatactctacaggggaggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 550504 - DNA, 414 bp, Homo sapiens
  misc_feature: HIJSMM301CCDI2.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggagcccagtgatggccagggaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 550505 - DNA, 487 bp, Homo sapiens
  misc_feature: HIJSMM301BTMAB.4.35.D02.1.454.light.4.raw
agcactgtagcacgaccggtgctcgatttagcacacgatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcgcggagggaccaaggtggagatcaaaacgaaactagtggctgcacc

SEQ ID NO: 550506 - DNA, 512 bp, Homo sapiens
  misc_feature: HIJSMM301C2352.8.21.B10.1.454.light.4.raw
ctcgcgtgtccacgaccggtgctcgatttagtgtcgtcgcaaggagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggaggatcaaacgaaactgtggcctagcaccatctgtcttcatcttctcgccattc

SEQ ID NO: 550507 - DNA, 489 bp, Homo sapiens; identical to SEQ ID NO: 542780
  misc_feature: HIJSMM301EG1SP.16.53.E09.1.454.light.4.raw

SEQ ID NO: 550508 - DNA, 497 bp, Homo sapiens
  misc_feature: HIJSMM301DJTZ0.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccggtccctaggt

SEQ ID NO: 550509 - DNA, 501 bp, Homo sapiens; identical to SEQ ID NO: 536818
  misc_feature: HIJSMM301AVEB1.12.82.H05.1.454.light.4.raw

SEQ ID NO: 550510 - DNA, 485 bp, Homo sapiens; identical to SEQ ID NO: 538194
  misc_feature: HIJSMM301AT765.47.62.F07.1.454.light.4.raw

SEQ ID NO: 550511 - DNA, 506 bp, Homo sapiens; identical to SEQ ID NO: 538047
  misc_feature: HIJSMM301CW07O.15.86.H09.1.454.light.4.raw

SEQ ID NO: 550512 - DNA, 511 bp, Homo sapiens
  misc_feature: HIJSMM301BCF6I.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccaccct

SEQ ID NO: 550513 - DNA, 511 bp, Homo sapiens
  misc_feature: HIJSMM301DGO8B.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgaccagtagaaatagagagaaccgtatggctgcgaccactctcgtcttcctatcttcccgt

SEQ ID NO: 550514 - DNA, 511 bp, Homo sapiens
  misc_feature: HIJSMM301BKUI4.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaggtggagtcaagcgaactgtggctgcaccatctgtcttcatcttcccgccta

SEQ ID NO: 550515 - DNA, 507 bp, Homo sapiens
  misc_feature: HIJSMM301D4XZT.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggagggaccacgctgaccgtcctaagtcagcccaaggctgccccctcggtcactctgttcccaccct

SEQ ID NO: 550516 - DNA, 492 bp, Homo sapiens
  misc_feature: HIJSMM301D26AY.51.62.F07.1.454.light.4.raw
cgatcgtatacacgaccggtgctcgatttagtagtcgcataaagggaaaggggagtcccaaccaggacacagcatggacatgagggtccctactcagctcctgggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctatttggaagacggggtcccatcccggttcagtgggagtggatctgggactaaatttttctttcaccatcaccaacctgcaacctgaggattttgcaacattatttctgtcaacaatatgataatgtccccaccgtcactttcggcggagggaccaaggtggacctcaaacgaactgtggctgcaccatctgtcttcta

SEQ ID NO: 550517 - DNA, 495 bp, Homo sapiens
  misc_feature: HIJSMM301CY7Q1.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggcctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacacctggccttttggcctaggggaccaacctggagatcaaatgaactgtggctgcaccatctgtctt

SEQ ID NO: 550518 - DNA, 497 bp, Homo sapiens
  misc_feature: HIJSMM301DZKMQ.51.14.B03.1.454.light.4.raw
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcggacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactagtggctgcaccatctgtcttcta

SEQ ID NO: 550519 - DNA, 500 bp, Homo sapiens
  misc_feature: HIJSMM301BZF4W.48.9.A09.1.454.light.4.raw
agtatacatacacgaccggtgctcgatttagcgagacgcgcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 550520 - DNA, 496 bp, Homo sapiens; identical to SEQ ID NO: 541772
  misc_feature: HIJSMM301D9YD8.51.81.H04.1.454.light.4.raw

SEQ ID NO: 550521 - DNA, 500 bp, Homo sapiens
  misc_feature: HIJSMM301EJJ0G.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaac

SEQ ID NO: 550522 - DNA, 476 bp, Homo sapiens; identical to SEQ ID NO: 549636
  misc_feature: HIJSMM301DEJUY.41.5.A05.1.454.light.4.raw

SEQ ID NO: 550523 - DNA, 488 bp, Homo sapiens; identical to SEQ ID NO: 536851
  misc_feature: HIJSMM301BPXCZ.41.2.A02.1.454.light.4.raw

SEQ ID NO: 550524 - DNA, 484 bp, Homo sapiens; identical to SEQ ID NO: 536162
  misc_feature: HIJSMM301EDAWQ.13.59.F04.1.454.light.4.raw

SEQ ID NO: 550525 - DNA, 481 bp, Homo sapiens; identical to SEQ ID NO: 545234
  misc_feature: HIJSMM301EYS4K.49.50.E06.1.454.light.4.raw

SEQ ID NO: 550526 - DNA, 504 bp, Homo sapiens
  misc_feature: HIJSMM301CE503.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 550527 - DNA, 492 bp, Homo sapiens
  misc_feature: HIJSMM301DUNIJ.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccggttcagtggcagcgggtctgggacagatttcactctcaccatcagcagcctgcaggctgaagatgtggcagtttattactgtcagcaatattatagtactcctccgaggctcactttcggtcggagggaccaaggtggagatcaacgaa

SEQ ID NO: 550528 - DNA, 500 bp, Homo sapiens
  misc_feature: HIJSMM301ECD33.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttagggatccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtctgggtcagcccaaggctgccccctcggt

SEQ ID NO: 550529 - DNA, 441 bp, Homo sapiens
  misc_feature: HIJSMM301BQ6V9.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 550530 - DNA, 480 bp, Homo sapiens
  misc_feature: HIJSMM301EGZJ1.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagatttgcagttatttctgtcagcagttaacactggcctggaagttttggccagggaccaagctggagctcaaacgaactgtggctgcaccat

SEQ ID NO: 550531 - DNA, 463 bp, Homo sapiens; identical to SEQ ID NO: 535008
  misc_feature: HIJSMM301C6PKG.10.9.A09.1.454.light.4.raw

SEQ ID NO: 550532 - DNA, 444 bp, Homo sapiens; identical to SEQ ID NO: 535856
  misc_feature: HIJSMM301AS9YX.9.9.A09.1.454.light.4.raw

SEQ ID NO: 550533 - DNA, 485 bp, Homo sapiens
  misc_feature: HIJSMM301AI7NS.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactagtggctgcacc

SEQ ID NO: 550534 - DNA, 497 bp, Homo sapiens
  misc_feature: HIJSMM301A2V7I.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagga

SEQ ID NO: 550535 - DNA, 483 bp, Homo sapiens
  misc_feature: HIJSMM301A7N7N.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcgagggaccaaggtgcagatcaaacgaactgtggctgca

SEQ ID NO: 550536 - DNA, 497 bp, Homo sapiens
  misc_feature: HIJSMM301EOUZC.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctcg

SEQ ID NO: 550537 - DNA, 515 bp, Homo sapiens
  misc_feature: HIJSMM301AUZUQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttggtccaaggaccgaaggtaggaaagtacgaaaacgaaactaagtggtctgcaccactctgtcttctatctttccccg

SEQ ID NO: 550538 - DNA, 498 bp, Homo sapiens
  misc_feature: HIJSMM301CY6O3.52.29.C07.1.454.light.4.raw
cgcagtacgacacgaccggtgctcgatttagagtgctacgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactctcg

SEQ ID NO: 550539 - DNA, 495 bp, Homo sapiens; identical to SEQ ID NO: 536931
  misc_feature: HIJSMM301BYVC2.10.33.C11.1.454.light.4.raw

SEQ ID NO: 550540 - DNA, 494 bp, Homo sapiens; identical to SEQ ID NO: 534992
  misc_feature: HIJSMM301CVKXF.9.1.A01.1.454.light.4.raw

SEQ ID NO: 550541 - DNA, 504 bp, Homo sapiens; identical to SEQ ID NO: 535561
  misc_feature: HIJSMM301CNM08.4.57.F02.1.454.light.4.raw

SEQ ID NO: 550542 - DNA, 503 bp, Homo sapiens
  misc_feature: HIJSMM301DQGEX.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 550543 - DNA, 488 bp, Homo sapiens
  misc_feature: HIJSMM301C7ZLF.3.14.B03.1.454.light.4.raw
  modified_base (485)..(485): a, c, t, g, unknown or other
agacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcactttatttcttgtcagcagtataataactagtccgcctcggcggtgcggtcggcggacggaggagtagagaacaagtacgagtgcgcacncta

SEQ ID NO: 550544 - DNA, 463 bp, Homo sapiens; identical to SEQ ID NO: 535062
  misc_feature: HIJSMM301ANPN4.11.73.G07.1.454.light.4.raw

SEQ ID NO: 550545 - DNA, 499 bp, Homo sapiens
  misc_feature: HIJSMM301AZ28T.43.53.E09.1.454.light.4.raw
  modified_base (467)..(467): a, c, t, g, unknown or other
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccactaattacgttcgaggacggaactagtacaactntacagtactagtggtcgctcgaccactcttcg

SEQ ID NO: 550546 - DNA, 487 bp, Homo sapiens; identical to SEQ ID NO: 536206
  misc_feature: HIJSMM301EDM7G.47.38.D05.1.454.light.4.raw

SEQ ID NO: 550547 - DNA, 441 bp, Homo sapiens; identical to SEQ ID NO: 534971
  misc_feature: HIJSMM301AMSJU.11.3.A03.1.454.light.4.raw

SEQ ID NO: 550548 - DNA, 495 bp, Homo sapiens; identical to SEQ ID NO: 535007
  misc_feature: HIJSMM301ETVCJ.22.5.A05.1.454.light.4.raw

SEQ ID NO: 550549 - DNA, 494 bp, Homo sapiens; identical to SEQ ID NO: 534994
  misc_feature: HIJSMM301ETW2N.27.78.H01.1.454.light.4.raw

SEQ ID NO: 550550 - DNA, 486 bp, Homo sapiens; identical to SEQ ID NO: 535043
  misc_feature: HIJSMM301BACOV.46.35.D02.1.454.light.4.raw

SEQ ID NO: 550551 - DNA, 506 bp, Homo sapiens
  misc_feature: HIJSMM301CSD6S.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 550552 - DNA, 495 bp, Homo sapiens
  misc_feature: HIJSMM301BI6DY.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagaattaaacgaactgtggctgcaccatctgtt

SEQ ID NO: 550553 - DNA, 486 bp, Homo sapiens
  misc_feature: HIJSMM301CTRC3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagtcaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 550554 - DNA, 486 bp, Homo sapiens
  misc_feature: HIJSMM301AIS1Z.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactagtggctgcaccatct

SEQ ID NO: 550555 - DNA, 491 bp, Homo sapiens; identical to SEQ ID NO: 535176
  misc_feature: HIJSMM301AT3X6.13.39.D06.1.454.light.4.raw

SEQ ID NO: 550556 - DNA, 489 bp, Homo sapiens; identical to SEQ ID NO: 535139
  misc_feature: HIJSMM301C9EYF.14.55.E11.1.454.light.4.raw

SEQ ID NO: 550557 - DNA, 511 bp, Homo sapiens
  misc_feature: HIJSMM301DKG99.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccacct

SEQ ID NO: 550558 - DNA, 498 bp, Homo sapiens
  misc_feature: HIJSMM301D2FH1.48.59.F04.1.454.light.4.raw
agtatacatacacgaccggtgctcgatttagtacacacacttagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctggttcggcggagggaccaagctgaccgtctaagtcagcccaaggctgccccctggtcact

SEQ ID NO: 550559 - DNA, 444 bp, Homo sapiens; identical to SEQ ID NO: 535192
  misc_feature: HIJSMM301AUYQN.5.9.A09.1.454.light.4.raw

SEQ ID NO: 550560 - DNA, 480 bp, Homo sapiens
  misc_feature: HIJSMM301BPKOX.53.83.H06.1.454.light.4.raw
cgcgtatacacacgaccggtgctcgatttagatcacgtgcgtcgcgggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggaactgggaccaaggtcaccg

SEQ ID NO: 550561 - DNA, 495 bp, Homo sapiens; identical to SEQ ID NO: 535821
  misc_feature: HIJSMM301AU2OO.3.31.C09.1.454.light.4.raw

SEQ ID NO: 550562 - DNA, 508 bp, Homo sapiens
  misc_feature: HIJSMM301B6Y4Y.14.57.F02.1.454.light.4.raw
cgtctagtaccacgaccggtgctcgatttagctcgatatagttgggtttgggggaacgtgctcagttaggacccagagggaaccatggaagccccacgctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcacttttcggcggggggaccgaaggtggaggttcaaacgaactgtggctgcaccatctgtcttcatcttcccgcca

SEQ ID NO: 550563 - DNA, 486 bp, Homo sapiens; identical to SEQ ID NO: 535043
  misc_feature: HIJSMM301DM0HD.46.35.D02.1.454.light.4.raw

SEQ ID NO: 550564 - DNA, 493 bp, Homo sapiens
  misc_feature: HIJSMM301EUFNE.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataaatgactggtggacgttcggccaagggaccaaggtaggagaaccaaacgaaactagtaggcgtgcaccact

SEQ ID NO: 550565 - DNA, 494 bp, Homo sapiens
  misc_feature: HIJSMM301DIFPI.49.78.H01.1.454.light.4.raw
  modified_base (492)..(492): a, c, t, g, unknown or other
agtcgagagacacgaccggtgctcgatttagtgtgagtagtttgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccgaagctggaggatcaagacggaactgttggcgtgcacccatctntt

SEQ ID NO: 550566 - DNA, 513 bp, Homo sapiens; identical to SEQ ID NO: 542511
  misc_feature: HIJSMM301BSSIE.16.88.H11.1.454.light.4.raw

SEQ ID NO: 550567 - DNA, 503 bp, Homo sapiens; identical to SEQ ID NO: 535044
  misc_feature: HIJSMM301BGVZW.19.78.H01.1.454.light.4.raw

SEQ ID NO: 550568 - DNA, 494 bp, Homo sapiens; identical to SEQ ID NO: 534992
  misc_feature: HIJSMM301CHIJ6.9.1.A01.1.454.light.4.raw

SEQ ID NO: 550569 - DNA, 497 bp, Homo sapiens; identical to SEQ ID NO: 534982
  misc_feature: HIJSMM301BMN7T.26.80.H03.1.454.light.4.raw

SEQ ID NO: 550570 - DNA, 501 bp, Homo sapiens
  misc_feature: HIJSMM301D15BV.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccccaaggccaacccccactgtcacttcc

SEQ ID NO: 550571 - DNA, 501 bp, Homo sapiens; identical to SEQ ID NO: 535746
  misc_feature: HIJSMM301EIAML.18.11.A11.1.454.light.4.raw

SEQ ID NO: 550572 - DNA, 495 bp, Homo sapiens
  misc_feature: HIJSMM301CZ2RN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattaagtggcagcgggtctgggacagatttcactctcaccatcagcagcctgcaggctgaagatgtggcagtttattattgtcagcaatattatattcctcctcagacttcggccaagggaccaaggtggaaatcaaacgaactgtggctgcacc

SEQ ID NO: 550573 - DNA, 304 bp, Homo sapiens
  misc_feature: HIJSMM301BJCE1.12.25.C03.1.454.light.4.raw
atacgacgtacacgaccggtgctcgatttagtagtgtagatttgggtttgggaacctatgaacattctgtaggggccactgtcttctccacggtgctcccttcatgcgtgacctggcagctgtagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccaccctcctctacgtcgtat

SEQ ID NO: 550574 - DNA, 468 bp, Homo sapiens
  misc_feature: HIJSMM301CSMV4.49.8.A08.1.454.light.4.raw
agtcgagagacacgaccggtgctcgatttagcatactctacaggggagagtgttagagggagaagtgcccccacctgctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtggctgcaccatctgtcttcatcttcccgc

SEQ ID NO: 550575 - DNA, 494 bp, Homo sapiens; identical to SEQ ID NO: 534992
  misc_feature: HIJSMM301COR5A.9.1.A01.1.454.light.4.raw

SEQ ID NO: 550576 - DNA, 502 bp, Homo sapiens
  misc_feature: HIJSMM301B6OV8.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcagggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcgcccccc

SEQ ID NO: 550577 - DNA, 501 bp, Homo sapiens
  misc_feature: HIJSMM301CT15W.22.21.B10.1.454.light.4.raw
acatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttggtgttcggcggagggccaagctgaccgtcctaggtcagcccaaggctgccccctggtcactctcg

SEQ ID NO: 550578 - DNA, 498 bp, Homo sapiens; identical to SEQ ID NO: 544885
  misc_feature: HIJSMM301D7ZGG.3.71.G05.1.454.light.4.raw

SEQ ID NO: 550579 - DNA, 507 bp, Homo sapiens; identical to SEQ ID NO: 535641
  misc_feature: HIJSMM301AGGAY.10.88.H11.1.454.light.4.raw

SEQ ID NO: 550580 - DNA, 494 bp, Homo sapiens; identical to SEQ ID NO: 535629
  misc_feature: HIJSMM301EO7VV.4.27.C05.1.454.light.4.raw

SEQ ID NO: 550581 - DNA, 497 bp, Homo sapiens; identical to SEQ ID NO: 535664
  misc_feature: HIJSMM301D61L1.22.14.B03.1.454.light.4.raw

SEQ ID NO: 550582 - DNA, 492 bp, Homo sapiens
  misc_feature: HIJSMM301EIF4G.10.72.G06.1.454.light.4.raw
catagtagtgcacgaccggtgctcgatttagctacgactgcaagggaaagggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 550583 - DNA, 512 bp, Homo sapiens
  misc_feature: HIJSMM301DTYB6.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgccta

SEQ ID NO: 550584 - DNA, 512 bp, Homo sapiens
  misc_feature: HIJSMM301D0E29.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaacttagagatcaaacgaactagtggctgcaccatctgtcttctatcttcccgtcccat

SEQ ID NO: 550585 - DNA, 493 bp, Homo sapiens; identical to SEQ ID NO: 535084
  misc_feature: HIJSMM301DDQ1D.47.64.F09.1.454.light.4.raw

SEQ ID NO: 550586 - DNA, 503 bp, Homo sapiens
  misc_feature: HIJSMM301CIN6U.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgatttattattgcagctcatatgcaggcagttacaatgtgatattcggcggagggaccaaactgaccgtcctaggtcagcccaaggctgccccctc

SEQ ID NO: 550587 - DNA, 444 bp, Homo sapiens; identical to SEQ ID NO: 535192
  misc_feature: HIJSMM301DB9PF.5.9.A09.1.454.light.4.raw

SEQ ID NO: 550588 - DNA, 506 bp, Homo sapiens; identical to SEQ ID NO: 545735
  misc_feature: HIJSMM301AWX0F.8.71.G05.1.454.light.4.raw

SEQ ID NO: 550589 - DNA, 514 bp, Homo sapiens
  misc_feature: HIJSMM301AL87T.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 550590 - DNA, 494 bp, Homo sapiens
  misc_feature: HIJSMM301CQT2O.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccattcagcgggacccaggctacggatgaggctgactattactgtcaggcgtgggacagcagcacctatgtggttttcggtcggagggaccgaagctcgaccgtccttggtcagcccaacggctcgtccccccg

SEQ ID NO: 550591 - DNA, 516 bp, Homo sapiens
  misc_feature: HIJSMM301AFFSM.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccgccctccc

SEQ ID NO: 550592 - DNA, 508 bp, Homo sapiens
  misc_feature: HIJSMM301EFQNH.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacaatcgtaccgagtggcctccgggggccactttcggcctcgggaccaaagtaggatatcaaacgaactagtggctgcaccatctgtctt

SEQ ID NO: 550593 - DNA, 503 bp, Homo sapiens; identical to SEQ ID NO: 535044
  misc_feature: HIJSMM301BARJ7.19.78.H01.1.454.light.4.raw

SEQ ID NO: 550594 - DNA, 505 bp, Homo sapiens; identical to SEQ ID NO: 536254
  misc_feature: HIJSMM301BCI69.7.71.G05.1.454.light.4.raw

SEQ ID NO: 550595 - DNA, 545 bp, Homo sapiens
  misc_feature: HIJSMM301CXHD2.17.33.C11.1.454.light.4.raw
  modified_base (518)..(518): a, c, t, g, unknown or other
cgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggctttcgacccgacgttactcgttaacttatgtcagcattcgcacttctgatacctccagcatgcctcacagcacaccttcacaggcttacagaacgctccctaccaacaacgcataagcgtcgctgccgcagcttcggtgcatgggtttanccccgtttcatcttccgccatctgact

SEQ ID NO: 550596 - DNA, 517 bp, Homo sapiens
  misc_feature: HIJSMM301B8GIZ.27.23.C01.1.454.light.4.raw
  modified_base (514)..(514): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctggtcactctgttccncct

SEQ ID NO: 550597 - DNA, 444 bp, Homo sapiens; identical to SEQ ID NO: 535027
  misc_feature: HIJSMM301A1JMX.8.73.G07.1.454.light.4.raw

SEQ ID NO: 550598 - DNA, 501 bp, Homo sapiens; identical to SEQ ID NO: 536142
  misc_feature: HIJSMM301DWH5I.15.1.A01.1.454.light.4.raw

SEQ ID NO: 550599 - DNA, 488 bp, Homo sapiens
  misc_feature: HIJSMM301AK9RE.49.23.C01.1.454.light.4.raw
agtcgagagacacgaccggtgctcgatttagtacacgtgattagggattgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagacgtgaagatgtggcagtgtattactgtcagcaatatcacactgctccgctcactttcggcggagggaccgagggtggagatcaaacgaacg

SEQ ID NO: 550600 - DNA, 483 bp, Homo sapiens; identical to SEQ ID NO: 535413
  misc_feature: HIJSMM301EFQFX.26.78.H01.1.454.light.4.raw

SEQ ID NO: 550601 - DNA, 488 bp, Homo sapiens; identical to SEQ ID NO: 535861
  misc_feature: HIJSMM301BYM3O.14.55.E11.1.454.light.4.raw

SEQ ID NO: 550602 - DNA, 505 bp, Homo sapiens
  misc_feature: HIJSMM301AKSDX.8.19.B08.1.454.light.4.raw
ctcgcgtgtccacgaccggtgctcgatttagtgagtcagtaaggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaaattagagatcaaacgaactgtggctgcaccatctgtcttcatcttcccgcc

SEQ ID NO: 550603 - DNA, 469 bp, Homo sapiens
  misc_feature: HIJSMM301DA152.51.75.G09.1.454.light.4.raw
cgatcgtatacacgaccggtgctcgatttagtatagacatcagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggagggacc

SEQ ID NO: 550604 - DNA, 504 bp, Homo sapiens; identical to SEQ ID NO: 539690
  misc_feature: HIJSMM301CL9KR.47.65.F10.1.454.light.4.raw

SEQ ID NO: 550605 - DNA, 495 bp, Homo sapiens
  misc_feature: HIJSMM301CXJ88.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcatt

SEQ ID NO: 550606 - DNA, 490 bp, Homo sapiens
  misc_feature: HIJSMM301BN932.3.55.E11.1.454.light.4.raw
agacgcactccacgaccggtgctcgatttagcactcgcacgttgggtttgggggaggaactgctcagttaggacccagacgtaaccatggaagccccagcgcagcttctcttcctcctgctactctggctcccagatgccactggagaagtggtgatgacgcagtctccagccaccctgtctgtgtctccaggggaaagagccaccctctcctgcagggtccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccgaagggaccaaggtagaaatcaaacgaactgtggctgcaccatctgtt

SEQ ID NO: 550607 - DNA, 484 bp, Homo sapiens
  misc_feature: HIJSMM301AWLPH.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagatttgcagtttattactgtcagcagtataatagctggcccgcgacgttcggccaagggaccgaggtggaattcaacgaactgtggctgcaccatctgtctt

SEQ ID NO: 550608 - DNA, 494 bp, Homo sapiens
  misc_feature: HIJSMM301C9Y8L.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctcaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccacctcctcgagtgcgtct

SEQ ID NO: 550609 - DNA, 500 bp, Homo sapiens; identical to SEQ ID NO: 539563
  misc_feature: HIJSMM301CVOUT.8.2.A02.1.454.light.4.raw

SEQ ID NO: 550610 - DNA, 494 bp, Homo sapiens
  misc_feature: HIJSMM301CQ3L9.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagtattttgctaactttattttgtcaacaggctaacacctttccccctcactttcggcggtagggaccaaggtggagatcaagcgaactgtggctgcacatctgtctt

SEQ ID NO: 550611 - DNA, 505 bp, Homo sapiens
  misc_feature: HIJSMM301DDXTG.15.1.A01.1.454.light.4.raw
  modified_base (475)..(475): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactccgtcctaccctcctcnctacgtacgatcgagcggcggtcgcgagac

SEQ ID NO: 550612 - DNA, 494 bp, Homo sapiens
  misc_feature: HIJSMM301B4ERJ.49.72.G06.1.454.light.4.raw
agtcgagagacacgaccggtgctcgatttagctacgactgcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaagg

SEQ ID NO: 550613 - DNA, 475 bp, Homo sapiens
  misc_feature: HIJSMM301COROB.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggaccaagctgaccgtcct

SEQ ID NO: 550614 - DNA, 488 bp, Homo sapiens
  misc_feature: HIJSMM301AC8TJ.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactagtggctgcaccatctgt

SEQ ID NO: 550615 - DNA, 501 bp, Homo sapiens
  misc_feature: HIJSMM301D0CW5.13.3.A03.1.454.light.4.raw
tcacgtactacacgaccggtgctcgatttagagagcgtcacaggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgcagctcatatacaagcggcagctctctttatctcttcggaggtgggaccaaggtcaccgtcctaagtcagcccaaggccaacccactgtcact

SEQ ID NO: 550616 - DNA, 491 bp, Homo sapiens
  misc_feature: HIJSMM301CSGOP.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttggcccagggaccacagtggatatcaggcgaactgtggctgcaccatctgtctt

SEQ ID NO: 550617 - DNA, 479 bp, Homo sapiens
  misc_feature: HIJSMM301DJN55.41.36.D03.1.454.light.4.raw
tctatactatcacgaccggtgctcgatttagctgcgtcacgatctctcttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaacacagcctccctgaccattactggactccaacctgaggacgaggctgactattattgctcagcatgggacaccagcctcaatgccgcggtattcggcgcagggaccaagctgaccgtccg

SEQ ID NO: 550618 - DNA, 490 bp, Homo sapiens; identical to SEQ ID NO: 538273
  misc_feature: HIJSMM301ADJVL.16.73.G07.1.454.light.4.raw

SEQ ID NO: 550619 - DNA, 485 bp, Homo sapiens; identical to SEQ ID NO: 539315
  misc_feature: HIJSMM301DZB3P.3.88.H11.1.454.light.4.raw

SEQ ID NO: 550620 - DNA, 482 bp, Homo sapiens; identical to SEQ ID NO: 535216
  misc_feature: HIJSMM301AUJJO.17.26.C04.1.454.light.4.raw

SEQ ID NO: 550621 - DNA, 472 bp, Homo sapiens
  misc_feature: HIJSMM301A7XT1.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtgg

SEQ ID NO: 550622 - DNA, 495 bp, Homo sapiens; identical to SEQ ID NO: 546146
  misc_feature: HIJSMM301AV81R.27.78.H01.1.454.light.4.raw

SEQ ID NO: 550623 - DNA, 492 bp, Homo sapiens
  misc_feature: HIJSMM301EDLT3.52.71.G05.1.454.light.4.raw
cgcagtacgacacgaccggtgctcgatttagtgtcgtcgcaagagagagggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaagctgaccgtcctgggtcagcccaac

SEQ ID NO: 550624 - DNA, 511 bp, Homo sapiens
  misc_feature: HIJSMM301AYQVY.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctcgggaccaaagtaggatatacaaacgaactagtggctgcaccatctgtcttcta

SEQ ID NO: 550625 - DNA, 509 bp, Homo sapiens; identical to SEQ ID NO: 535670
  misc_feature: HIJSMM301C30FC.47.23.C01.1.454.light.4.raw

SEQ ID NO: 550626 - DNA, 498 bp, Homo sapiens
  misc_feature: HIJSMM301C0BMM.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaacgaactgtggctgcaccatctgtcttcta

SEQ ID NO: 550627 - DNA, 507 bp, Homo sapiens
  misc_feature: HIJSMM301ATYI7.49.23.C01.1.454.light.4.raw
agtcgagagacacgaccggtgctcgatttagtacacgtgattagggattgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgtt

SEQ ID NO: 550628 - DNA, 488 bp, Homo sapiens; identical to SEQ ID NO: 535081
  misc_feature: HIJSMM301B78LT.26.23.C01.1.454.light.4.raw

SEQ ID NO: 550629 - DNA, 472 bp, Homo sapiens
  misc_feature: HIJSMM301A18OJ.48.56.F01.1.454.light.4.raw
agtatacatacacgaccggtgctcgatttagcagacgtctgaacacacaaaggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttacggccaagggaccaaggtgaaatcaaacgaa

SEQ ID NO: 550630 - DNA, 494 bp, Homo sapiens; identical to SEQ ID NO: 534994
  misc_feature: HIJSMM301BYCX1.27.78.H01.1.454.light.4.raw

SEQ ID NO: 550631 - DNA, 471 bp, Homo sapiens
  misc_feature: HIJSMM301DEVAL.3.38.D05.1.454.light.4.raw
  modified_base (416)..(416): a, c, t, g, unknown or other
agacgcactccacgaccggtgctcgatttagtatctgatagttgggtttggggcaggagtcagtctcagtcaggacacagcatggacatgagggtcccctctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacanagtttcactacccctctcactttcggcgggggaccgaaggtggagatcaaacgaa

SEQ ID NO: 550632 - DNA, 479 bp, Homo sapiens; identical to SEQ ID NO: 535118
  misc_feature: HIJSMM301BF8P5.13.59.F04.1.454.light.4.raw

SEQ ID NO: 550633 - DNA, 492 bp, Homo sapiens
  misc_feature: HIJSMM301C16EW.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcaccgtccaaggtc

SEQ ID NO: 550634 - DNA, 505 bp, Homo sapiens
  misc_feature: HIJSMM301DOTB9.48.87.H10.1.454.light.4.raw
agtatacatacacgaccggtgctcgatttagcagtactgcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 550635 - DNA, 502 bp, Homo sapiens
  misc_feature: HIJSMM301AT5FI.53.8.A08.1.454.light.4.raw
cgcgtatacacacgaccggtgctcgatttagcatactctacagggggtgggtccaggaggcagaactctgggtgtctcaccatggcctggatccctctacttctccccctcctcactctctgcacaggctctgaggcctcccatgagttgatacagccatcctcggtgtcagtgtccccaggacagacggccacgattatttgctctggagatgcattggcaaagcaatttgcttcttggttccagcagaagccaggccaagcccctgtactggtgatttataaaggctctgagaggcccccagggatccctgagcgattctctgggtccgactcagggacaacagccatgttgaccatcagtggagtccaggcagaagacgaggctgactattattgtcagtcagcagacaacactgttgtttctgtgtttttcggcggagggaccaggctgaccgtcctgggtcagcccaaggctgccccctcggtcactctgttccccg

SEQ ID NO: 550636 - DNA, 483 bp, Homo sapiens
  misc_feature: HIJSMM301DLYXW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccagggaccaagctggagatcaacgaactgtggctgcaccat

SEQ ID NO: 550637 - DNA, 491 bp, Homo sapiens
  misc_feature: HIJSMM301AYBJJ.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctcggt

SEQ ID NO: 550638 - DNA, 506 bp, Homo sapiens
  misc_feature: HIJSMM301A1ID6.21.22.B11.1.454.light.4.raw
tcgtcgctcgcacgaccggtgctcgatttagacgacagctcagggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggacccccaaactcctcactccagaggaataatcagcggccctcaggggtccctgaccgattctctggctccaagtctggcacctcagcctccctgtaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 550639 - DNA, 494 bp, Homo sapiens
  misc_feature: HIJSMM301C6CN3.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtactacttttggccggggaccaagctaggaatcaagcaactgtggctgcacatctgtcttcattccc

SEQ ID NO: 550640 - DNA, 493 bp, Homo sapiens
  misc_feature: HIJSMM301ANCRZ.26.55.E11.1.454.light.4.raw
agactatactcacgaccggtgctcgatttagcactcgcacgttgggtttggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgtcaacttactactgtcaacagagttacaggcccccactactttgttcgacggacggaacactcgaggatcacagaacgtatggcgtgcgaccaact

SEQ ID NO: 550641 - DNA, 492 bp, Homo sapiens
  misc_feature: HIJSMM301BKF55.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccagccctccagtctgaggatgaggctgactattactgtcagacctggggcacttggttatggttggttttcggcggagggaccaagctgaccgtcctaggtcacgccaacggctcccg

SEQ ID NO: 550642 - DNA, 485 bp, Homo sapiens
  misc_feature: HIJSMM301CM24V.41.39.D06.1.454.light.4.raw
tctatactatcacgaccggtgctcgatttagtgacatctcgcagttctttggggagagaagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtctattactgtcagcagtatggtggctcacctccgtacacctttggccaggggaccaagctggagatcaaacgaactgt

SEQ ID NO: 550643 - DNA, 490 bp, Homo sapiens
  misc_feature: HIJSMM301B0LBK.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccgggggatctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 550644 - DNA, 485 bp, Homo sapiens; identical to SEQ ID NO: 535363
  misc_feature: HIJSMM301A45TM.17.26.C04.1.454.light.4.raw

SEQ ID NO: 550645 - DNA, 505 bp, Homo sapiens
  misc_feature: HIJSMM301DK68L.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 550646 - DNA, 498 bp, Homo sapiens
  misc_feature: HIJSMM301BZUJJ.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgacaccctgaccatcaacagggtccggactgaagacgaggctgactattactgcttgtctggggatgaggacacattggtgttcggcggagggaccaagctgaccgtcctacgtcagcccaaggctgccccctcggtcactctgtt

SEQ ID NO: 550647 - DNA, 444 bp, Homo sapiens
  misc_feature: HIJSMM301AFLT5.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccttcctccgtgtctgat

SEQ ID NO: 550648 - DNA, 479 bp, Homo sapiens
  misc_feature: HIJSMM301AL3K2.4.33.C11.1.454.light.4.raw
agcactgtagcacgaccggtgctcgatttagagtgagctcgttgggtttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacc

SEQ ID NO: 550649 - DNA, 494 bp, Homo sapiens
  misc_feature: HIJSMM301AYY5J.51.69.G03.1.454.light.4.raw
cgatcgtatacacgaccggtgctcgatttagtcgctgcgtaaaggagaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcggcggagggaccaaggtgaccgtcct

SEQ ID NO: 550650 - DNA, 494 bp, Homo sapiens
  misc_feature: HIJSMM301E3SEV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacgaacggacggagatcagacgaactagtggcgtgcaccactctcgtcttcta

SEQ ID NO: 550651 - DNA, 485 bp, Homo sapiens; identical to SEQ ID NO: 542735
  misc_feature: HIJSMM301ARVMV.26.45.E01.1.454.light.4.raw

SEQ ID NO: 550652 - DNA, 349 bp, Homo sapiens
  misc_feature: HIJSMM301EP90W.12.53.E09.1.454.light.4.raw
atacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgccctcctctacgtcgtat

SEQ ID NO: 550653 - DNA, 506 bp, Homo sapiens; identical to SEQ ID NO: 534969
  misc_feature: HIJSMM301DKB50.18.37.D04.1.454.light.4.raw

SEQ ID NO: 550654 - DNA, 486 bp, Homo sapiens; identical to SEQ ID NO: 535043
  misc_feature: HIJSMM301EE1F2.46.35.D02.1.454.light.4.raw

SEQ ID NO: 550655 - DNA, 462 bp, Homo sapiens; identical to SEQ ID NO: 542244
  misc_feature: HIJSMM301B5S5V.49.73.G07.1.454.light.4.raw

SEQ ID NO: 550656 - DNA, 499 bp, Homo sapiens; identical to SEQ ID NO: 539754
  misc_feature: HIJSMM301DQHEX.11.21.B10.1.454.light.4.raw

SEQ ID NO: 550657 - DNA, 473 bp, Homo sapiens; identical to SEQ ID NO: 535262
  misc_feature: HIJSMM301CW2WS.8.67.G01.1.454.light.4.raw

SEQ ID NO: 550658 - DNA, 510 bp, Homo sapiens
  misc_feature: HIJSMM301BTI7H.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctggtcactctgttcccaccctcctcgctacgtaga

SEQ ID NO: 550659 - DNA, 492 bp, Homo sapiens
  misc_feature: HIJSMM301AN8EK.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctccggtc

SEQ ID NO: 550660 - DNA, 518 bp, Homo sapiens; identical to SEQ ID NO: 543797
  misc_feature: HIJSMM301B9KY2.19.80.H03.1.454.light.4.raw

SEQ ID NO: 550661 - DNA, 492 bp, Homo sapiens
  misc_feature: HIJSMM301BEUPL.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatacagcagggtggaggctgaggatggtcgggtttacgtactgcaaatgcagggtacactctggccgttctactttggtccgagggaccgaaactaggatatcagacgaactgtgg

SEQ ID NO: 550662 - DNA, 499 bp, Homo sapiens
  misc_feature: HIJSMM301CAZ6C.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtccaccgtcctaggtcagcccaagacccaaccccactgt

SEQ ID NO: 550663 - DNA, 504 bp, Homo sapiens
  misc_feature: HIJSMM301CJLVJ.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgt

SEQ ID NO: 550664 - DNA, 485 bp, Homo sapiens
  misc_feature: HIJSMM301BSIYA.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaggatttcgcagtttattactgtcagcagcgtagcaactggctgatcaccttcggccaagggacacgactggagattaaacgaactgtggctgcacc

SEQ ID NO: 550665 - DNA, 509 bp, Homo sapiens
  misc_feature: HIJSMM301BHYGZ.48.38.D05.1.454.light.4.raw
agtatacatacacgaccggtgctcgatttagtatctgatagttgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatcgaactgtggctgcaccatctgtcttcatcttccccg

SEQ ID NO: 550666 - DNA, 491 bp, Homo sapiens
  misc_feature: HIJSMM301CNL10.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcggcctgcagtctgaagattttgcagtttattactgtcagcagtataattactggccgccgacgttcggccaagggaccaaggtggaaatcaaacgaactgtggctgcaccatctgtt

SEQ ID NO: 550667 - DNA, 484 bp, Homo sapiens; identical to SEQ ID NO: 535400
  misc_feature: HIJSMM301CMPJI.46.26.C04.1.454.light.4.raw

SEQ ID NO: 550668 - DNA, 483 bp, Homo sapiens
  misc_feature: HIJSMM301AHSI3.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaaggtggaaatacaaacgaactagtggctgcacca

SEQ ID NO: 550669 - DNA, 499 bp, Homo sapiens
  misc_feature: HIJSMM301AOU6Z.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcacttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 550670 - DNA, 506 bp, Homo sapiens; identical to SEQ ID NO: 537290
  misc_feature: HIJSMM301EQJF2.13.11.A11.1.454.light.4.raw

SEQ ID NO: 550671 - DNA, 477 bp, Homo sapiens
  misc_feature: HIJSMM301CZUJL.14.11.A11.1.454.light.4.raw
  modified_base (385)..(385): a, c, t, g, unknown or other
  modified_base (410)..(410): a, c, t, g, unknown or other
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaacgtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtcccatcaaggttcagcggcagtggatctggcacagatttcactctcaccatcagcagcctgcagcctgaanatttgcaacttatactgtctacaanattacaattaccctcaacgttcggccaagggaccaaggtggaagtcaaacgaactgtggctgcacca

SEQ ID NO: 550672 - DNA, 508 bp, Homo sapiens; identical to SEQ ID NO: 536388
  misc_feature: HIJSMM301DCA3J.11.57.F02.1.454.light.4.raw

SEQ ID NO: 550673 - DNA, 504 bp, Homo sapiens; identical to SEQ ID NO: 544677
  misc_feature: HIJSMM301DE7TH.7.71.G05.1.454.light.4.raw

SEQ ID NO: 550674 - DNA, 486 bp, Homo sapiens; identical to SEQ ID NO: 535043
  misc_feature: HIJSMM301ERLAZ.46.35.D02.1.454.light.4.raw

SEQ ID NO: 550675 - DNA, 493 bp, Homo sapiens; identical to SEQ ID NO: 550263
  misc_feature: HIJSMM301BFE2U.14.36.D03.1.454.light.4.raw

SEQ ID NO: 550676 - DNA, 494 bp, Homo sapiens; identical to SEQ ID NO: 534994
  misc_feature: HIJSMM301D4UC3.27.78.H01.1.454.light.4.raw

SEQ ID NO: 550677 - DNA, 444 bp, Homo sapiens; identical to SEQ ID NO: 534993
  misc_feature: HIJSMM301CRT47.5.9.A09.1.454.light.4.raw

SEQ ID NO: 550678 - DNA, 444 bp, Homo sapiens
  misc_feature: HIJSMM301C8FUP.49.82.H05.1.454.light.4.raw
agtcgagagacacgaccggtgctcgatttagtcgagctctctcgcgggcacgaccggtgctcgatttagtcacgcgagaaagggaaaggggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccaccctcctctctctcgact

SEQ ID NO: 550679 - DNA, 478 bp, Homo sapiens
  misc_feature: HIJSMM301DF4FB.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattactgcatgcaagctctacaaaccctattcactttcggtccctgggaccagagtggata

SEQ ID NO: 550680 - DNA, 494 bp, Homo sapiens; identical to SEQ ID NO: 536477
  misc_feature: HIJSMM301CHQ9Q.22.5.A05.1.454.light.4.raw

SEQ ID NO: 550681 - DNA, 492 bp, Homo sapiens
  misc_feature: HIJSMM301CTVEU.10.37.D04.1.454.light.4.raw
catagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggcgttcgcaaggaccaaggtggacctcaacgaactgtggctgca

SEQ ID NO: 550682 - DNA, 383 bp, Homo sapiens
  misc_feature: HIJSMM301BN4FH.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 550683 - DNA, 508 bp, Homo sapiens
  misc_feature: HIJSMM301BREHZ.47.55.E11.1.454.light.4.raw
agctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtca

SEQ ID NO: 550684 - DNA, 486 bp, Homo sapiens; identical to SEQ ID NO: 536323
  misc_feature: HIJSMM301CVDVC.10.2.A02.1.454.light.4.raw

SEQ ID NO: 550685 - DNA, 470 bp, Homo sapiens; identical to SEQ ID NO: 536130
  misc_feature: HIJSMM301A8DL8.7.81.H04.1.454.light.4.raw

SEQ ID NO: 550686 - DNA, 496 bp, Homo sapiens; identical to SEQ ID NO: 537925
  misc_feature: HIJSMM301D4QO4.22.14.B03.1.454.light.4.raw

SEQ ID NO: 550687 - DNA, 487 bp, Homo sapiens; identical to SEQ ID NO: 538190
  misc_feature: HIJSMM301EYOGF.47.70.G04.1.454.light.4.raw

SEQ ID NO: 550688 - DNA, 477 bp, Homo sapiens
  misc_feature: HIJSMM301D7RMA.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaagactgtggctgcaccat

SEQ ID NO: 550689 - DNA, 476 bp, Homo sapiens
  misc_feature: HIJSMM301AV70D.3.1.A01.1.454.light.4.raw
agacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccatctgtctt

SEQ ID NO: 550690 - DNA, 503 bp, Homo sapiens; identical to SEQ ID NO: 538884
  misc_feature: HIJSMM301D9BWG.27.78.H01.1.454.light.4.raw

SEQ ID NO: 550691 - DNA, 473 bp, Homo sapiens
  misc_feature: HIJSMM301DSBIK.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtgggtcccatcaaggttcagtggcagtggatctgggacagatttcactctcactgtcagcagtctgcaatttgaagattttgcaacttactactgtcaacagagtttcagttatcccttggactttcggccaagggaccaaggtggaaatcaaacgaa

SEQ ID NO: 550692 - DNA, 495 bp, Homo sapiens
  misc_feature: HIJSMM301CVH02.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccacctcctcgagtgcgtct

SEQ ID NO: 550693 - DNA, 488 bp, Homo sapiens
  misc_feature: HIJSMM301CNT63.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtcttca

SEQ ID NO: 550694 - DNA, 498 bp, Homo sapiens
  misc_feature: HIJSMM301CIGBP.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatcctgtcttcatcttccccg

SEQ ID NO: 550695 - DNA, 485 bp, Homo sapiens
  misc_feature: HIJSMM301AZG47.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggtctgttcggtcggcgggaccg

SEQ ID NO: 550696 - DNA, 494 bp, Homo sapiens; identical to SEQ ID NO: 534992
  misc_feature: HIJSMM301B3L0W.9.1.A01.1.454.light.4.raw

SEQ ID NO: 550697 - DNA, 509 bp, Homo sapiens
  misc_feature: HIJSMM301CQYMR.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaaatctggcaacacggcctccctgaccatctctgggctcgagtctgaggacgaggctgattacttctgttgctcttgggcaactactgtcgtttgggtgttcggcggagggaccaagttgaccgtcctaggtcagccaaggctgcccctccggtcactctgtt

SEQ ID NO: 550698 - DNA, 496 bp, Homo sapiens
  misc_feature: HIJSMM301CGMZH.13.76.G10.1.454.light.4.raw
tcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgcccc

SEQ ID NO: 550699 - DNA, 491 bp, Homo sapiens; identical to SEQ ID NO: 535194
  misc_feature: HIJSMM301DOI9Q.26.78.H01.1.454.light.4.raw

SEQ ID NO: 550700 - DNA, 447 bp, Homo sapiens; identical to SEQ ID NO: 535201
  misc_feature: HIJSMM301CGRB1.18.9.A09.1.454.light.4.raw

SEQ ID NO: 550701 - DNA, 496 bp, Homo sapiens
  misc_feature: HIJSMM301CZER5.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccgccctcctcgtatct

SEQ ID NO: 550702 - DNA, 509 bp, Homo sapiens; identical to SEQ ID NO: 543772
  misc_feature: HIJSMM301A3I67.2.21.B10.1.454.light.4.raw

SEQ ID NO: 550703 - DNA, 485 bp, Homo sapiens; identical to SEQ ID NO: 541539
  misc_feature: HIJSMM301AMCU4.3.10.A10.1.454.light.4.raw

SEQ ID NO: 550704 - DNA, 512 bp, Homo sapiens
  misc_feature: HIJSMM301C1VJ6.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 550705 - DNA, 514 bp, Homo sapiens
  misc_feature: HIJSMM301DP26L.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccacctcct

SEQ ID NO: 550706 - DNA, 484 bp, Homo sapiens; identical to SEQ ID NO: 535400
  misc_feature: HIJSMM301BSCTH.46.26.C04.1.454.light.4.raw

SEQ ID NO: 550707 - DNA, 486 bp, Homo sapiens; identical to SEQ ID NO: 535043
  misc_feature: HIJSMM301EBQ41.46.35.D02.1.454.light.4.raw

SEQ ID NO: 550708 - DNA, 508 bp, Homo sapiens
  misc_feature: HIJSMM301C0PIG.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagccaaggctcgcccctcggtcactctcgtccct

SEQ ID NO: 550709 - DNA, 503 bp, Homo sapiens
  misc_feature: HIJSMM301BXCCB.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcgagcagcggggcaattggccgctcactttcggcgggggaccgaaggtggagttcaaacgaactgtggctgcaccatctgtcttcatcttcccg

SEQ ID NO: 550710 - DNA, 521 bp, Homo sapiens
  misc_feature: HIJSMM301CAAEG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccaggtcagcccaaggctgccccctcggtcactctcgttcccgccct

SEQ ID NO: 550711 - DNA, 481 bp, Homo sapiens; identical to SEQ ID NO: 545917
  misc_feature: HIJSMM301ATT6U.52.5.A05.1.454.light.4.raw

SEQ ID NO: 550712 - DNA, 500 bp, Homo sapiens; identical to SEQ ID NO: 535310
  misc_feature: HIJSMM301B21YU.47.66.F11.1.454.light.4.raw

SEQ ID NO: 550713 - DNA, 504 bp, Homo sapiens
  misc_feature: HIJSMM301DSWMM.51.42.D09.1.454.light.4.raw
cgatcgtatacacgaccggtgctcgatttagacacatacgcagggaaagggggatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgtctt

SEQ ID NO: 550714 - DNA, 444 bp, Homo sapiens; identical to SEQ ID NO: 535192
  misc_feature: HIJSMM301B4U2P.5.9.A09.1.454.light.4.raw

SEQ ID NO: 550715 - DNA, 460 bp, Homo sapiens; identical to SEQ ID NO: 536053
  misc_feature: HIJSMM301B0MRL.22.28.C06.1.454.light.4.raw

SEQ ID NO: 550716 - DNA, 516 bp, Homo sapiens
  misc_feature: HIJSMM301CPF5P.12.71.G05.1.454.light.4.raw
atacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 550717 - DNA, 515 bp, Homo sapiens
  misc_feature: HIJSMM301C9EYW.17.33.C11.1.454.light.4.raw
  modified_base (425)..(425): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggnggtgctgtgctattcggcggagggaccaagctgaccgtcttaagtcagcccaaggctcgccccctcggtcactctgtcccgccctcctcc

SEQ ID NO: 550718 - DNA, 501 bp, Homo sapiens; identical to SEQ ID NO: 535746
  misc_feature: HIJSMM301A1C6A.18.11.A11.1.454.light.4.raw

SEQ ID NO: 550719 - DNA, 488 bp, Homo sapiens; identical to SEQ ID NO: 535990
  misc_feature: HIJSMM301BHCK2.11.28.C06.1.454.light.4.raw

SEQ ID NO: 550720 - DNA, 516 bp, Homo sapiens
  misc_feature: HIJSMM301BIWE9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacggaccgaacggtggaagtacaaacgaactacgtggctgcaccactctgtcttctactcttcccgtcctact

SEQ ID NO: 550721 - DNA, 498 bp, Homo sapiens
  misc_feature: HIJSMM301ENGH3.52.28.C06.1.454.light.4.raw
cgcagtacgacacgaccggtgctcgatttagagctcacgtattgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcta

SEQ ID NO: 550722 - DNA, 494 bp, Homo sapiens; identical to SEQ ID NO: 541159
  misc_feature: HIJSMM301A2H6V.15.59.F04.1.454.light.4.raw

SEQ ID NO: 550723 - DNA, 505 bp, Homo sapiens
  misc_feature: HIJSMM301ANBUI.48.71.G05.1.454.light.4.raw
agtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 550724 - DNA, 377 bp, Homo sapiens
  misc_feature: HIJSMM301C6LOU.49.61.F06.1.454.light.4.raw
agtcgagagacacgaccggtgctcgatttagctacgctctaagggaaagggggggtctcgaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaacccactgtcactctgttcccaccctcctctctctcgact

SEQ ID NO: 550725 - DNA, 491 bp, Homo sapiens
  misc_feature: HIJSMM301C92HY.52.27.C05.1.454.light.4.raw
cgcagtacgacacgaccggtgctcgatttagacgcgatcgaagggtttggggagtctcaggtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctcaacctgaagattttgcaatttactactgtcaacagagtgacaatacccctcagactttcggccctggaccagagtggatatcaaacgaactagtggctgcaccatcctgtcttcactt

SEQ ID NO: 550726 - DNA, 484 bp, Homo sapiens
  misc_feature: HIJSMM301D5XUG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaactgtggctgcaccatctgt

SEQ ID NO: 550727 - DNA, 516 bp, Homo sapiens
  misc_feature: HIJSMM301CIPH5.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatgttgcaccgcaaagcggggacccagaccctggagcctcagttggaagcagccgatccagcctgcggagcctgtggggcaggtcagcccaaggctgccccctcggtcactctgttcccacctcctccacg

SEQ ID NO: 550728 - DNA, 521 bp, Homo sapiens; identical to SEQ ID NO: 539470
  misc_feature: HIJSMM301BZN8S.27.23.C01.1.454.light.4.raw

SEQ ID NO: 550729 - DNA, 463 bp, Homo sapiens; identical to SEQ ID NO: 535062
  misc_feature: HIJSMM301DCU40.11.73.G07.1.454.light.4.raw

SEQ ID NO: 550730 - DNA, 521 bp, Homo sapiens
  misc_feature: HIJSMM301CAG6E.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgccctaggtcagcccaaggctgccccctcggtcactctgttcccaccct

SEQ ID NO: 550731 - DNA, 508 bp, Homo sapiens
  misc_feature: HIJSMM301C99QD.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggtccagggacccgacggtggaggaatcagacgaaacctagtgggcgtgcacccactctgtcttctactcttcccgt

SEQ ID NO: 550732 - DNA, 444 bp, Homo sapiens; identical to SEQ ID NO: 540477
  misc_feature: HIJSMM301CY3CR.17.21.B10.1.454.light.4.raw

SEQ ID NO: 550733 - DNA, 486 bp, Homo sapiens; identical to SEQ ID NO: 535385
  misc_feature: HIJSMM301CYV1A.19.71.G05.1.454.light.4.raw

SEQ ID NO: 550734 - DNA, 445 bp, Homo sapiens
  misc_feature: HIJSMM301EKUGR.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttggggtgttcggcggagggaccaagctgaccgtcctaagtcagcccaaggctgccccctcggtcactctgttcccaccctcctccgtgtctgat

SEQ ID NO: 550735 - DNA, 504 bp, Homo sapiens; identical to SEQ ID NO: 537401
  misc_feature: HIJSMM301C47MW.51.23.C01.1.454.light.4.raw

SEQ ID NO: 550736 - DNA, 508 bp, Homo sapiens
  misc_feature: HIJSMM301DE55X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggacccaaggtggaaatacaaacgaactagtggctgcaccatctgtcttcatcttccccg

SEQ ID NO: 550737 - DNA, 473 bp, Homo sapiens; identical to SEQ ID NO: 538711
  misc_feature: HIJSMM301C1SVR.11.17.B06.1.454.light.4.raw

SEQ ID NO: 550738 - DNA, 444 bp, Homo sapiens; identical to SEQ ID NO: 534993
  misc_feature: HIJSMM301B70Z9.5.9.A09.1.454.light.4.raw

SEQ ID NO: 550739 - DNA, 503 bp, Homo sapiens
  misc_feature: HIJSMM301CTVZ2.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccactttcggccctgggaccaaagtggatatcaaacgaactgtggctgcaccatctgt

SEQ ID NO: 550740 - DNA, 511 bp, Homo sapiens
  misc_feature: HIJSMM301CG047.3.27.C05.1.454.light.4.raw
agacgcactccacgaccggtgctcgatttagacgcgatcgaagggtttggggacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctcgaccgattcaatggcagcgggtctggggcagatttcactctcaccatcagcagcctgcaggctgaagatgtggcagtttattactgtcagcaatattatactcctcttccgacgttcggtccgaaggaccgaaggtaggaaagtacaaacgaaactagtggctgcaccaatctgtctt

SEQ ID NO: 550741 - DNA, 504 bp, Homo sapiens; identical to SEQ ID NO: 547306
  misc_feature: HIJSMM301B7UEE.10.71.G05.1.454.light.4.raw

SEQ ID NO: 550742 - DNA, 494 bp, Homo sapiens; identical to SEQ ID NO: 534992
  misc_feature: HIJSMM301EFSF5.9.1.A01.1.454.light.4.raw

SEQ ID NO: 550743 - DNA, 498 bp, Homo sapiens; identical to SEQ ID NO: 543188
  misc_feature: HIJSMM301DBWVW.10.65.F10.1.454.light.4.raw

SEQ ID NO: 550744 - DNA, 486 bp, Homo sapiens; identical to SEQ ID NO: 535043
  misc_feature: HIJSMM301CC8JO.46.35.D02.1.454.light.4.raw

SEQ ID NO: 550745 - DNA, 505 bp, Homo sapiens
  misc_feature: HIJSMM301E348M.14.55.E11.1.454.light.4.raw
  modified_base (426)..(426): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtcaacttactactgtcaacagagttacacgtaccccncctcctcgtcggtcgggacggacggaacgaggaggatacgacgaacgaacgtacgtggtcgcgcaccactattcttctt

SEQ ID NO: 550746 - DNA, 494 bp, Homo sapiens
  misc_feature: HIJSMM301D9137.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaagctggagatcaaccgaactgtggctgcaccatctgt

SEQ ID NO: 550747 - DNA, 487 bp, Homo sapiens; identical to SEQ ID NO: 539440
  misc_feature: HIJSMM301AX8C7.8.12.B01.1.454.light.4.raw

SEQ ID NO: 550748 - DNA, 444 bp, Homo sapiens
  misc_feature: HIJSMM301ES35Y.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccttcctcgacacgcgag

SEQ ID NO: 550749 - DNA, 486 bp, Homo sapiens; identical to SEQ ID NO: 537617
  misc_feature: HIJSMM301BNR8Y.10.53.E09.1.454.light.4.raw

SEQ ID NO: 550750 - DNA, 490 bp, Homo sapiens; identical to SEQ ID NO: 535526
  misc_feature: HIJSMM301APHLZ.26.78.H01.1.454.light.4.raw

SEQ ID NO: 550751 - DNA, 497 bp, Homo sapiens; identical to SEQ ID NO: 541552
  misc_feature: HIJSMM301DVFZW.48.82.H05.1.454.light.4.raw

SEQ ID NO: 550752 - DNA, 447 bp, Homo sapiens; identical to SEQ ID NO: 535020
  misc_feature: HIJSMM301EM0CV.18.9.A09.1.454.light.4.raw

SEQ ID NO: 550753 - DNA, 444 bp, Homo sapiens; identical to SEQ ID NO: 534993
  misc_feature: HIJSMM301C1G8T.5.9.A09.1.454.light.4.raw

SEQ ID NO: 550754 - DNA, 491 bp, Homo sapiens
  misc_feature: HIJSMM301A2GWY.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcctaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctccagtatgatgcttaccctcggactttcggtccgaagggaccgaaggtaggaaagtacaaacgaaactagtggcgtgcacca

SEQ ID NO: 550755 - DNA, 501 bp, Homo sapiens
  misc_feature: HIJSMM301AZE9E.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttccg

SEQ ID NO: 550756 - DNA, 463 bp, Homo sapiens; identical to SEQ ID NO: 535062
  misc_feature: HIJSMM301C3VG4.11.73.G07.1.454.light.4.raw

SEQ ID NO: 550757 - DNA, 488 bp, Homo sapiens
  misc_feature: HIJSMM301AYQCJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaacaatattattatacttcgtggacgttggccaagggaccaaggtggatatcagacgaa

SEQ ID NO: 550758 - DNA, 493 bp, Homo sapiens; identical to SEQ ID NO: 536246
  misc_feature: HIJSMM301ALPRA.49.66.F11.1.454.light.4.raw

SEQ ID NO: 550759 - DNA, 517 bp, Homo sapiens; identical to SEQ ID NO: 541955
  misc_feature: HIJSMM301DLT6O.22.30.C08.1.454.light.4.raw

SEQ ID NO: 550760 - DNA, 444 bp, Homo sapiens; identical to SEQ ID NO: 535192
  misc_feature: HIJSMM301C95Y0.5.9.A09.1.454.light.4.raw

SEQ ID NO: 550761 - DNA, 494 bp, Homo sapiens; identical to SEQ ID NO: 535629
  misc_feature: HIJSMM301DOP3B.4.27.C05.1.454.light.4.raw

SEQ ID NO: 550762 - DNA, 444 bp, Homo sapiens
  misc_feature: HIJSMM301BCOZX.2.76.G10.1.454.light.4.raw
acgctcgacacacgaccggtgctcgatttagtcactcatacagggtcctgggcccagtctgtgctgactcagccaccctcagcgtctggggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 550763 - DNA, 499 bp, Homo sapiens
  misc_feature: HIJSMM301AVBE3.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 550764 - DNA, 506 bp, Homo sapiens; identical to SEQ ID NO: 539434
  misc_feature: HIJSMM301AN7BL.48.71.G05.1.454.light.4.raw

SEQ ID NO: 550765 - DNA, 490 bp, Homo sapiens; identical to SEQ ID NO: 535234
  misc_feature: HIJSMM301ESQ6Q.17.21.B10.1.454.light.4.raw

SEQ ID NO: 550766 - DNA, 497 bp, Homo sapiens; identical to SEQ ID NO: 534982
  misc_feature: HIJSMM301DQM2I.26.80.H03.1.454.light.4.raw

SEQ ID NO: 550767 - DNA, 484 bp, Homo sapiens; identical to SEQ ID NO: 544689
  misc_feature: HIJSMM301BXWHP.22.6.A06.1.454.light.4.raw

SEQ ID NO: 550768 - DNA, 489 bp, Homo sapiens
  misc_feature: HIJSMM301D9N0D.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccaaggcggagatcagacgaactgtgctgcaccatctgtcttcta

SEQ ID NO: 550769 - DNA, 485 bp, Homo sapiens
  misc_feature: HIJSMM301CVIUI.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcgcaggaccgaagtggaagtacaacgaactagtggctgcaccat

SEQ ID NO: 550770 - DNA, 490 bp, Homo sapiens; identical to SEQ ID NO: 535420
  misc_feature: HIJSMM301B6DHA.3.72.G06.1.454.light.4.raw

SEQ ID NO: 550771 - DNA, 481 bp, Homo sapiens; identical to SEQ ID NO: 535993
  misc_feature: HIJSMM301ALBK2.21.25.C03.1.454.light.4.raw

SEQ ID NO: 550772 - DNA, 419 bp, Homo sapiens; identical to SEQ ID NO: 537535
  misc_feature: HIJSMM301DMTP6.18.78.H01.1.454.light.4.raw

SEQ ID NO: 550773 - DNA, 483 bp, Homo sapiens; identical to SEQ ID NO: 541990
  misc_feature: HIJSMM301CX9KE.46.26.C04.1.454.light.4.raw

SEQ ID NO: 550774 - DNA, 489 bp, Homo sapiens; identical to SEQ ID NO: 543809
  misc_feature: HIJSMM301C9OLF.19.71.G05.1.454.light.4.raw

SEQ ID NO: 550775 - DNA, 490 bp, Homo sapiens
  misc_feature: HIJSMM301CNYB0.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaacgaactgtggctgcaccatctgtcttcat

SEQ ID NO: 550776 - DNA, 444 bp, Homo sapiens; identical to SEQ ID NO: 535192
  misc_feature: HIJSMM301CTNIM.5.9.A09.1.454.light.4.raw

SEQ ID NO: 550777 - DNA, 474 bp, Homo sapiens
  misc_feature: HIJSMM301BYW6T.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccg

SEQ ID NO: 550778 - DNA, 498 bp, Homo sapiens; identical to SEQ ID NO: 535295
  misc_feature: HIJSMM301CW7NA.15.25.C03.1.454.light.4.raw

SEQ ID NO: 550779 - DNA, 484 bp, Homo sapiens
  misc_feature: HIJSMM301AYNLF.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggccaggggaccaaggtcgaaatgagacgaactgtggctgcaccat

SEQ ID NO: 550780 - DNA, 463 bp, Homo sapiens; identical to SEQ ID NO: 535062
  misc_feature: HIJSMM301B3TTH.11.73.G07.1.454.light.4.raw

SEQ ID NO: 550781 - DNA, 487 bp, Homo sapiens
  misc_feature: HIJSMM301BSHMZ.48.60.F05.1.454.light.4.raw
agtatacatacacgaccggtgctcgatttagtacgtcatcagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 550782 - DNA, 505 bp, Homo sapiens
  misc_feature: HIJSMM301AM94R.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactc

SEQ ID NO: 550783 - DNA, 479 bp, Homo sapiens; identical to SEQ ID NO: 538734
  misc_feature: HIJSMM301CW8N2.8.53.E09.1.454.light.4.raw

SEQ ID NO: 550784 - DNA, 498 bp, Homo sapiens
  misc_feature: HIJSMM301AWCLE.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaaacgaactgtggctgcaccc

SEQ ID NO: 550785 - DNA, 494 bp, Homo sapiens
  misc_feature: HIJSMM301D23CY.16.10.A10.1.454.light.4.raw
tgtactactccacgaccggtgctcgatttagcgtcgatctcagggggtgggtccaggaggcagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccg

SEQ ID NO: 550786 - DNA, 384 bp, Homo sapiens; identical to SEQ ID NO: 549932
  misc_feature: HIJSMM301B9IOH.41.26.C04.1.454.light.4.raw

SEQ ID NO: 550787 - DNA, 489 bp, Homo sapiens; identical to SEQ ID NO: 535139
  misc_feature: HIJSMM301C0QXF.14.55.E11.1.454.light.4.raw

SEQ ID NO: 550788 - DNA, 486 bp, Homo sapiens; identical to SEQ ID NO: 535043
  misc_feature: HIJSMM301BXEWE.46.35.D02.1.454.light.4.raw

SEQ ID NO: 550789 - DNA, 513 bp, Homo sapiens
  misc_feature: HIJSMM301AR2TF.9.43.D10.1.454.light.4.raw
tgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctcgttcccaccctcctcacg

SEQ ID NO: 550790 - DNA, 480 bp, Homo sapiens
  misc_feature: HIJSMM301C2YQ5.48.34.D01.1.454.light.4.raw
agtatacatacacgaccggtgctcgatttagatcgtctgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 550791 - DNA, 494 bp, Homo sapiens; identical to SEQ ID NO: 534994
  misc_feature: HIJSMM301CMHZ4.27.78.H01.1.454.light.4.raw

SEQ ID NO: 550792 - DNA, 447 bp, Homo sapiens; identical to SEQ ID NO: 535882
  misc_feature: HIJSMM301A822Y.18.9.A09.1.454.light.4.raw
  modified_base (429)..(429): a, c, t, g, unknown or other

SEQ ID NO: 550793 - DNA, 521 bp, Homo sapiens
  misc_feature: HIJSMM301EX0UU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtaggaaggtacgaaacgaactacgtaggcgtgcaccactctgtcttctactcttcccgtccact

SEQ ID NO: 550794 - DNA, 490 bp, Homo sapiens
  misc_feature: HIJSMM301DUBOY.14.55.E11.1.454.light.4.raw
cgtctagtaccacgaccggtgctcgatttagcactcgcacgttggggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 550795 - DNA, 490 bp, Homo sapiens
  misc_feature: HIJSMM301EDO91.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcacatctgtt

SEQ ID NO: 550796 - DNA, 494 bp, Homo sapiens; identical to SEQ ID NO: 534994
  misc_feature: HIJSMM301BZK7F.27.78.H01.1.454.light.4.raw

SEQ ID NO: 550797 - DNA, 494 bp, Homo sapiens; identical to SEQ ID NO: 534992
  misc_feature: HIJSMM301DQKM6.9.1.A01.1.454.light.4.raw

SEQ ID NO: 550798 - DNA, 495 bp, Homo sapiens; identical to SEQ ID NO: 536055
  misc_feature: HIJSMM301B9ZLZ.47.38.D05.1.454.light.4.raw

SEQ ID NO: 550799 - DNA, 506 bp, Homo sapiens
  misc_feature: HIJSMM301DAG7Q.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtggaaatcaaaacgaactagtggctgcaccatctcgtcttcactcttccccg

SEQ ID NO: 550800 - DNA, 488 bp, Homo sapiens; identical to SEQ ID NO: 547064
  misc_feature: HIJSMM301BVNKN.47.36.D03.1.454.light.4.raw

SEQ ID NO: 550801 - DNA, 488 bp, Homo sapiens
  misc_feature: HIJSMM301CBEH3.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccttcaggctttctaatcgcttctctggctccaagtctggcaacacggcctccctgacaatctctgggctccaggctgacgacgaggctaattattactgctgctcatatgaaggttataacactatactattcggcggagggaccgaagctgaccgtcctgcgtcagcccaacggctgccccctccggtcactctgttcccgccctcctccgctacgtaga

SEQ ID NO: 550802 - DNA, 502 bp, Homo sapiens
  misc_feature: HIJSMM301BVAET.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtgggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 550803 - DNA, 503 bp, Homo sapiens; identical to SEQ ID NO: 538884
  misc_feature: HIJSMM301BPHRV.27.78.H01.1.454.light.4.raw

SEQ ID NO: 550804 - DNA, 493 bp, Homo sapiens
  misc_feature: HIJSMM301ADB7S.49.38.D05.1.454.light.4.raw
agtcgagagacacgaccggtgctcgatttagtatctgatagttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccgggacactttcggcggagggaccaaggtggaggatcaaacgaactagtggctgcaccat

SEQ ID NO: 550805 - DNA, 520 bp, Homo sapiens
  misc_feature: HIJSMM301A9F6P.27.23.C01.1.454.light.4.raw
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccnccct

SEQ ID NO: 550806 - DNA, 509 bp, Homo sapiens; identical to SEQ ID NO: 545002
  misc_feature: HIJSMM301DIQR8.14.7.A07.1.454.light.4.raw

SEQ ID NO: 550807 - DNA, 489 bp, Homo sapiens; identical to SEQ ID NO: 535139
  misc_feature: HIJSMM301D7M03.14.55.E11.1.454.light.4.raw

SEQ ID NO: 550808 - DNA, 499 bp, Homo sapiens
  misc_feature: HIJSMM301CHY0D.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcact

SEQ ID NO: 550809 - DNA, 467 bp, Homo sapiens; identical to SEQ ID NO: 535997
  misc_feature: HIJSMM301ECGNL.5.36.D03.1.454.light.4.raw

SEQ ID NO: 550810 - DNA, 516 bp, Homo sapiens
  misc_feature: HIJSMM301CS2YN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgccgaacgggaccgaacggtaggaaggtacaaacgaactagtggcgtgcaccatctgtcttctatcttcccgtccact

SEQ ID NO: 550811 - DNA, 506 bp, Homo sapiens
  misc_feature: HIJSMM301BFVSS.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaaattgagatcaaacgaactagtggctgcaccatctgtcttcatcttcccgcc

SEQ ID NO: 550812 - DNA, 501 bp, Homo sapiens
  misc_feature: HIJSMM301CBMS3.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcataccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 550813 - DNA, 504 bp, Homo sapiens
  misc_feature: HIJSMM301AGW3U.48.33.C11.1.454.light.4.raw
agtatacatacacgaccggtgctcgatttagagtgagctcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 550814 - DNA, 512 bp, Homo sapiens
  misc_feature: HIJSMM301EDFE9.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctgttcccaccctcctccgtgtctgat

SEQ ID NO: 550815 - DNA, 447 bp, Homo sapiens; identical to SEQ ID NO: 535882
  misc_feature: HIJSMM301C8QBQ.18.9.A09.1.454.light.4.raw
  modified_base (429)..(429): a, c, t, g, unknown or other

SEQ ID NO: 550816 - DNA, 503 bp, Homo sapiens
  misc_feature: HIJSMM301DBLGC.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggttccgtaatcgcttctctggctccaagtctggcgacacggcctccctcgaccatctctgggctccagactgaagacgaggctgattattactgcagctcatatacaggcagcagcactcaggttttcggcggagggaccgaaagcgtgaccgtccctagtcgagcccaaggctcgccccctccggt

SEQ ID NO: 550817 - DNA, 484 bp, Homo sapiens; identical to SEQ ID NO: 535400
  misc_feature: HIJSMM301EQ5BM.46.26.C04.1.454.light.4.raw

SEQ ID NO: 550818 - DNA, 522 bp, Homo sapiens; identical to SEQ ID NO: 543352
  misc_feature: HIJSMM301BXFHM.27.23.C01.1.454.light.4.raw

SEQ ID NO: 550819 - DNA, 509 bp, Homo sapiens; identical to SEQ ID NO: 537131
  misc_feature: HIJSMM301CC7FR.17.33.C11.1.454.light.4.raw

SEQ ID NO: 550820 - DNA, 505 bp, Homo sapiens; identical to SEQ ID NO: 535503
  misc_feature: HIJSMM301EV472.8.28.C06.1.454.light.4.raw

SEQ ID NO: 550821 - DNA, 501 bp, Homo sapiens
  misc_feature: HIJSMM301C6SQX.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcacatctgtcttcattcc

SEQ ID NO: 550822 - DNA, 492 bp, Homo sapiens; identical to SEQ ID NO: 536175
  misc_feature: HIJSMM301AG9BR.19.83.H06.1.454.light.4.raw

SEQ ID NO: 550823 - DNA, 492 bp, Homo sapiens
  misc_feature: HIJSMM301DFJTZ.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcact

SEQ ID NO: 550824 - DNA, 504 bp, Homo sapiens
  misc_feature: HIJSMM301DURL2.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccgggtccgaggatgaggctgactattactgtgcatcacgggacgcaacatgggatgacaatctgagcggttgggtgttcggcggagggaccaaactgaccgtcctaggtccagcccaa

SEQ ID NO: 550825 - DNA, 516 bp, Homo sapiens; identical to SEQ ID NO: 540714
  misc_feature: HIJSMM301AI1Y1.51.43.D10.1.454.light.4.raw

SEQ ID NO: 550826 - DNA, 488 bp, Homo sapiens; identical to SEQ ID NO: 542936
  misc_feature: HIJSMM301CH3F6.22.86.H09.1.454.light.4.raw

SEQ ID NO: 550827 - DNA, 509 bp, Homo sapiens
  misc_feature: HIJSMM301B1EUT.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcacggacgacacgtagaatagaagacgaacgtagtggcgtgcaccactctcgtcttctactcttccctccc

SEQ ID NO: 550828 - DNA, 510 bp, Homo sapiens
  misc_feature: HIJSMM301EMFZ1.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgccact

SEQ ID NO: 550829 - DNA, 495 bp, Homo sapiens; identical to SEQ ID NO: 547042
  misc_feature: HIJSMM301D9W55.51.59.F04.1.454.light.4.raw

SEQ ID NO: 550830 - DNA, 472 bp, Homo sapiens
  misc_feature: HIJSMM301BN30Z.51.61.F06.1.454.light.4.raw
cgatcgtatacacgaccggtgctcgatttagctacgctctaagggaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaa

SEQ ID NO: 550831 - DNA, 486 bp, Homo sapiens; identical to SEQ ID NO: 539826
  misc_feature: HIJSMM301AD85T.5.23.C01.1.454.light.4.raw

SEQ ID NO: 550832 - DNA, 444 bp, Homo sapiens; identical to SEQ ID NO: 534993
  misc_feature: HIJSMM301BYN25.5.9.A09.1.454.light.4.raw

SEQ ID NO: 550833 - DNA, 444 bp, Homo sapiens
  misc_feature: HIJSMM301EVDU1.48.23.C01.1.454.light.4.raw
agtatacatacacgaccggtgctcgatttagtacacgtgattagggattggggggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctcggtcactctgttcccaccctcctctatgtatact

SEQ ID NO: 550834 - DNA, 485 bp, Homo sapiens
  misc_feature: HIJSMM301BMIVP.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactgtgctgcacat

SEQ ID NO: 550835 - DNA, 497 bp, Homo sapiens; identical to SEQ ID NO: 536376
  misc_feature: HIJSMM301A255I.22.9.A09.1.454.light.4.raw

SEQ ID NO: 550836 - DNA, 467 bp, Homo sapiens
  misc_feature: HIJSMM301ERIZO.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgtgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctccgctcactttcggcggagggaccaaggtggagatcaaacgaa

SEQ ID NO: 550837 - DNA, 504 bp, Homo sapiens
  misc_feature: HIJSMM301BSKEA.48.57.F02.1.454.light.4.raw
agtatacatacacgaccggtgctcgatttagctcgatatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 550838 - DNA, 471 bp, Homo sapiens; identical to SEQ ID NO: 536918
  misc_feature: HIJSMM301AXLK8.4.75.G09.1.454.light.4.raw

SEQ ID NO: 550839 - DNA, 497 bp, Homo sapiens
  misc_feature: HIJSMM301DT1F2.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagccaaggccaacccactg

SEQ ID NO: 550840 - DNA, 506 bp, Homo sapiens; identical to SEQ ID NO: 540748
  misc_feature: HIJSMM301A86Q3.18.37.D04.1.454.light.4.raw

SEQ ID NO: 550841 - DNA, 460 bp, Homo sapiens; identical to SEQ ID NO: 537107
  misc_feature: HIJSMM301BXS60.22.28.C06.1.454.light.4.raw

SEQ ID NO: 550842 - DNA, 490 bp, Homo sapiens; identical to SEQ ID NO: 535936
  misc_feature: HIJSMM301ARLO9.16.68.G02.1.454.light.4.raw

SEQ ID NO: 550843 - DNA, 516 bp, Homo sapiens
  misc_feature: HIJSMM301DFV1U.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggaccgtcgtcgacgacgaacgtacggaagtacgtaagacgaaccgtagtaggcgtggcaccgacactcgtcttcctatcttcctt

SEQ ID NO: 550844 - DNA, 514 bp, Homo sapiens
  misc_feature: HIJSMM301ETFGM.43.59.F04.1.454.light.4.raw
tgtgagtagtcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctcagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctcgccccctggtccactctcgtt

SEQ ID NO: 550845 - DNA, 478 bp, Homo sapiens
  misc_feature: HIJSMM301AQZXH.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggc

SEQ ID NO: 550846 - DNA, 489 bp, Homo sapiens; identical to SEQ ID NO: 549642
  misc_feature: HIJSMM301BW8BS.52.70.G04.1.454.light.4.raw

SEQ ID NO: 550847 - DNA, 487 bp, Homo sapiens
  misc_feature: HIJSMM301ECW19.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaacgaactgtggctgcaccatctgtt

SEQ ID NO: 550848 - DNA, 488 bp, Homo sapiens; identical to SEQ ID NO: 537504
  misc_feature: HIJSMM301DHLUN.17.57.F02.1.454.light.4.raw

SEQ ID NO: 550849 - DNA, 496 bp, Homo sapiens; identical to SEQ ID NO: 537925
  misc_feature: HIJSMM301CB1KI.22.14.B03.1.454.light.4.raw

SEQ ID NO: 550850 - DNA, 498 bp, Homo sapiens; identical to SEQ ID NO: 547576
  misc_feature: HIJSMM301ALKV5.12.37.D04.1.454.light.4.raw

SEQ ID NO: 550851 - DNA, 460 bp, Homo sapiens; identical to SEQ ID NO: 536053
  misc_feature: HIJSMM301AX5BM.22.28.C06.1.454.light.4.raw

SEQ ID NO: 550852 - DNA, 503 bp, Homo sapiens; identical to SEQ ID NO: 538256
  misc_feature: HIJSMM301BNIF8.19.67.G01.1.454.light.4.raw

SEQ ID NO: 550853 - DNA, 496 bp, Homo sapiens; identical to SEQ ID NO: 546893
  misc_feature: HIJSMM301AL7PW.51.35.D02.1.454.light.4.raw

SEQ ID NO: 550854 - DNA, 495 bp, Homo sapiens
  misc_feature: HIJSMM301CQYE5.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttattgtcttcggatctggaccgaggtcgaccgtcctaggtcagcccaacggccgaaccccacctcg

SEQ ID NO: 550855 - DNA, 470 bp, Homo sapiens
  misc_feature: HIJSMM301CJIMO.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccgaaggtggagatcaaacgaa

SEQ ID NO: 550856 - DNA, 489 bp, Homo sapiens; identical to SEQ ID NO: 545019
  misc_feature: HIJSMM301AT51H.19.57.F02.1.454.light.4.raw

SEQ ID NO: 550857 - DNA, 488 bp, Homo sapiens; identical to SEQ ID NO: 537260
  misc_feature: HIJSMM301EK0RS.47.70.G04.1.454.light.4.raw

SEQ ID NO: 550858 - DNA, 504 bp, Homo sapiens; identical to SEQ ID NO: 537401
  misc_feature: HIJSMM301CV6VH.51.23.C01.1.454.light.4.raw

SEQ ID NO: 550859 - DNA, 488 bp, Homo sapiens; identical to SEQ ID NO: 545628
  misc_feature: HIJSMM301DZUW8.14.55.E11.1.454.light.4.raw

SEQ ID NO: 550860 - DNA, 442 bp, Homo sapiens
  misc_feature: HIJSMM301DTBAW.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgcccctcctcgtatctctcg

SEQ ID NO: 550861 - DNA, 498 bp, Homo sapiens; identical to SEQ ID NO: 535974
  misc_feature: HIJSMM301DEZH3.22.27.C05.1.454.light.4.raw

SEQ ID NO: 550862 - DNA, 521 bp, Homo sapiens; identical to SEQ ID NO: 538715
  misc_feature: HIJSMM301A4UO7.27.23.C01.1.454.light.4.raw

SEQ ID NO: 550863 - DNA, 499 bp, Homo sapiens
  misc_feature: HIJSMM301ECNGF.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcatttccaagttcctttttgtcttcggaactgggaccgaggtcaccgtcctaggtcagcccaaggccaaccca

SEQ ID NO: 550864 - DNA, 373 bp, Homo sapiens; identical to SEQ ID NO: 537212
  misc_feature: HIJSMM301EYLIP.21.25.C03.1.454.light.4.raw

SEQ ID NO: 550865 - DNA, 486 bp, Homo sapiens; identical to SEQ ID NO: 536165
  misc_feature: HIJSMM301B16N8.5.71.G05.1.454.light.4.raw

SEQ ID NO: 550866 - DNA, 501 bp, Homo sapiens; identical to SEQ ID NO: 535746
  misc_feature: HIJSMM301DJSLZ.18.11.A11.1.454.light.4.raw

SEQ ID NO: 550867 - DNA, 486 bp, Homo sapiens; identical to SEQ ID NO: 535043
  misc_feature: HIJSMM301B7468.46.35.D02.1.454.light.4.raw

SEQ ID NO: 550868 - DNA, 506 bp, Homo sapiens; identical to SEQ ID NO: 541085
  misc_feature: HIJSMM301B3VGS.16.46.E02.1.454.light.4.raw

SEQ ID NO: 550869 - DNA, 509 bp, Homo sapiens
  misc_feature: HIJSMM301B0RH6.49.11.A11.1.454.light.4.raw
agtcgagagacacgaccggtgctcgatttagctacgactgcagggagaagggctggatgacttgggatggggagagagacccctcccctgggatcctgcagctccaggctcccgtgggtggggttagagtctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggt

SEQ ID NO: 550870 - DNA, 510 bp, Homo sapiens
  misc_feature: HIJSMM301BEWNV.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcggggggaccgaagctgaccgtcctaggtcagcccaaggctgtccccccg

SEQ ID NO: 550871 - DNA, 511 bp, Homo sapiens
  misc_feature: HIJSMM301DQVDT.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacaccttggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgtt

SEQ ID NO: 550872 - DNA, 502 bp, Homo sapiens; identical to SEQ ID NO: 549179
  misc_feature: HIJSMM301A4ILV.14.57.F02.1.454.light.4.raw

SEQ ID NO: 550873 - DNA, 487 bp, Homo sapiens; identical to SEQ ID NO: 535704
  misc_feature: HIJSMM301AV6JS.52.83.H06.1.454.light.4.raw

SEQ ID NO: 550874 - DNA, 518 bp, Homo sapiens
  misc_feature: HIJSMM301BPQU7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaacggtaggaagtacgaacgaactagtgcgtgcaccactctgtcttctatcttcccgtcccactctcgat

SEQ ID NO: 550875 - DNA, 490 bp, Homo sapiens
  misc_feature: HIJSMM301DCR10.13.36.D03.1.454.light.4.raw
tcacgtactacacgaccggtgctcgatttagctgcgtcacgatctctcttgggggggtcgagagctctggggagggaactgctcagttaggacccacgacggaaccatggaagccccacgcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtggggtctgggacagacttcactctcaccatcagcagcctgcagtctgaagattttgcagtctattactgtcagcagtatagttactggagaaccttcggccaagggacacgactggagattaaaggaa

SEQ ID NO: 550876 - DNA, 416 bp, Homo sapiens; identical to SEQ ID NO: 539343
  misc_feature: HIJSMM301CNHF8.18.78.H01.1.454.light.4.raw

SEQ ID NO: 550877 - DNA, 404 bp, Homo sapiens; identical to SEQ ID NO: 535779
  misc_feature: HIJSMM301D90J2.4.35.D02.1.454.light.4.raw

SEQ ID NO: 550878 - DNA, 495 bp, Homo sapiens; identical to SEQ ID NO: 547561
  misc_feature: HIJSMM301EXVVA.3.58.F03.1.454.light.4.raw

SEQ ID NO: 550879 - DNA, 483 bp, Homo sapiens; identical to SEQ ID NO: 542200
  misc_feature: HIJSMM301CI3C7.7.75.G09.1.454.light.4.raw

SEQ ID NO: 550880 - DNA, 505 bp, Homo sapiens; identical to SEQ ID NO: 538496
  misc_feature: HIJSMM301AOYTF.48.71.G05.1.454.light.4.raw

SEQ ID NO: 550881 - DNA, 517 bp, Homo sapiens
  misc_feature: HIJSMM301BFEGW.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgggtccgaggatgaggctgattattactgtgcagcatgggatgacagcctgagtggtccttgggtgttcggcggagggaccaagctgaccgtcctaagtcagcccaaggctgccccctcggtcactctcgttcccaccctcctcg

SEQ ID NO: 550882 - DNA, 494 bp, Homo sapiens; identical to SEQ ID NO: 534992
  misc_feature: HIJSMM301ELUQK.9.1.A01.1.454.light.4.raw

SEQ ID NO: 550883 - DNA, 517 bp, Homo sapiens; identical to SEQ ID NO: 539798
  misc_feature: HIJSMM301AQA2L.14.70.G04.1.454.light.4.raw

SEQ ID NO: 550884 - DNA, 512 bp, Homo sapiens
  misc_feature: HIJSMM301EULJF.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccacctcct

SEQ ID NO: 550885 - DNA, 505 bp, Homo sapiens
  misc_feature: HIJSMM301AGWVM.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 550886 - DNA, 521 bp, Homo sapiens; identical to SEQ ID NO: 536990
  misc_feature: HIJSMM301B88DJ.27.23.C01.1.454.light.4.raw
  modified_base (517)..(517): a, c, t, g, unknown or other

SEQ ID NO: 550887 - DNA, 508 bp, Homo sapiens
  misc_feature: HIJSMM301B092Q.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaaccccactgtcactctgttccca

SEQ ID NO: 550888 - DNA, 508 bp, Homo sapiens
  misc_feature: HIJSMM301BNI1Y.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatctaccttccggtccgaacgggaacgaccgactggagaattaaacgtaaactgtggctgaccaccactctgtcttctactt

SEQ ID NO: 550889 - DNA, 517 bp, Homo sapiens
  misc_feature: HIJSMM301BNS3B.51.53.E09.1.454.light.4.raw
cgatcgtatacacgaccggtgctcgatttagagagagtgtgttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcccccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccgaagggaccaaggtggaaatcaaacgaactgtggctgcaccatctgtcttcatcttccccg

SEQ ID NO: 550890 - DNA, 485 bp, Homo sapiens
  misc_feature: HIJSMM301CB47N.52.69.G03.1.454.light.4.raw
cgcagtacgacacgaccggtgctcgatttagtcgctgcgtaaaggagaaaggggagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccatctgtt

SEQ ID NO: 550891 - DNA, 505 bp, Homo sapiens
  misc_feature: HIJSMM301AKZ26.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaatcaaacgaactagtggctgcaccat

SEQ ID NO: 550892 - DNA, 502 bp, Homo sapiens
  misc_feature: HIJSMM301DIHIY.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 550893 - DNA, 506 bp, Homo sapiens
  misc_feature: HIJSMM301EYJ5B.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactagtggctgcaccatctgtcttcatcttcccgcc

SEQ ID NO: 550894 - DNA, 490 bp, Homo sapiens; identical to SEQ ID NO: 543909
  misc_feature: HIJSMM301DKN0K.14.55.E11.1.454.light.4.raw

SEQ ID NO: 550895 - DNA, 472 bp, Homo sapiens; identical to SEQ ID NO: 547803
  misc_feature: HIJSMM301B0DCQ.5.34.D01.1.454.light.4.raw

SEQ ID NO: 550896 - DNA, 490 bp, Homo sapiens; identical to SEQ ID NO: 535526
  misc_feature: HIJSMM301C41I4.26.78.H01.1.454.light.4.raw

SEQ ID NO: 550897 - DNA, 507 bp, Homo sapiens; identical to SEQ ID NO: 539466
  misc_feature: HIJSMM301DZ6I5.8.33.C11.1.454.light.4.raw

SEQ ID NO: 550898 - DNA, 475 bp, Homo sapiens; identical to SEQ ID NO: 548160
  misc_feature: HIJSMM301ATL1F.52.1.A01.1.454.light.4.raw

SEQ ID NO: 550899 - DNA, 507 bp, Homo sapiens; identical to SEQ ID NO: 541461
  misc_feature: HIJSMM301AM9LE.11.57.F02.1.454.light.4.raw

SEQ ID NO: 550900 - DNA, 479 bp, Homo sapiens; identical to SEQ ID NO: 537163
  misc_feature: HIJSMM301EHVVG.13.73.G07.1.454.light.4.raw

SEQ ID NO: 550901 - DNA, 490 bp, Homo sapiens; identical to SEQ ID NO: 538414
  misc_feature: HIJSMM301AQEST.49.67.G01.1.454.light.4.raw

SEQ ID NO: 550902 - DNA, 490 bp, Homo sapiens; identical to SEQ ID NO: 540853
  misc_feature: HIJSMM301DCRZK.43.33.C11.1.454.light.4.raw

SEQ ID NO: 550903 - DNA, 486 bp, Homo sapiens; identical to SEQ ID NO: 537144
  misc_feature: HIJSMM301DX9QC.46.35.D02.1.454.light.4.raw

SEQ ID NO: 550904 - DNA, 490 bp, Homo sapiens
  misc_feature: HIJSMM301AN63J.43.33.C11.1.454.light.4.raw
tgtgagtagtcacgaccggtgctcgatttagagtgagctcgttgggtttgggggcgagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgtggctgcacca

SEQ ID NO: 550905 - DNA, 529 bp, Homo sapiens
  misc_feature: HIJSMM301A4QEI.43.59.F04.1.454.light.4.raw
tgtgagtagtcacgaccggtgctcgatttagtacacacacttagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaaaaaacctctcctgcactggaagtagcagtgacgttggaacttatgaccatgtctcctggtaccaacaatacccaggcaaacgcccccaaactcttgatttatgatgtcacttatccggccctcgtaggggtttcttatcgcttctctggctccaagtctggcaacacggcctccctgaccatctcgtgggctccaggctgaggacgaggctgattattactgcaactcacttacaacgaccgacacttgcgtattcggcgggcgggaccaagctgaccgtctaggtcagcccaaggctcgccccctcggtcactctcgttccccg

SEQ ID NO: 550906 - DNA, 504 bp, Homo sapiens; identical to SEQ ID NO: 542411
  misc_feature: HIJSMM301DNDWK.9.53.E09.1.454.light.4.raw

SEQ ID NO: 550907 - DNA, 497 bp, Homo sapiens; identical to SEQ ID NO: 535664
  misc_feature: HIJSMM301EBPDX.22.14.B03.1.454.light.4.raw

SEQ ID NO: 550908 - DNA, 482 bp, Homo sapiens
  misc_feature: HIJSMM301DI50Q.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttgcggtaccccgtacacttttggccaggggaccaaactggacatcaaacgaactgtggctgcaccat

SEQ ID NO: 550909 - DNA, 501 bp, Homo sapiens
  misc_feature: HIJSMM301BXIAA.48.83.H06.1.454.light.4.raw
  modified_base (498)..(498): a, c, t, g, unknown or other
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtttcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgcccctcggtcactctgttcccncct

SEQ ID NO: 550910 - DNA, 486 bp, Homo sapiens
  misc_feature: HIJSMM301EJQNN.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctacaccatcagcagcctgcagcctgaagattttgcaacttactattgtcaacaggctaacagtttccctttaatcttcggccaagggacacgactggagattaaacgaactgtggctgcacca

SEQ ID NO: 550911 - DNA, 447 bp, Homo sapiens; identical to SEQ ID NO: 535020
  misc_feature: HIJSMM301AQ388.18.9.A09.1.454.light.4.raw

SEQ ID NO: 550912 - DNA, 505 bp, Homo sapiens; identical to SEQ ID NO: 536254
  misc_feature: HIJSMM301CU9R7.7.71.G05.1.454.light.4.raw

SEQ ID NO: 550913 - DNA, 492 bp, Homo sapiens
  misc_feature: HIJSMM301CJ1SV.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagccccaaggccaaccccactgtcactctgttcccaccctcctctacgtcgtat

SEQ ID NO: 550914 - DNA, 492 bp, Homo sapiens
  misc_feature: HIJSMM301E0127.49.62.F07.1.454.light.4.raw
agtcgagagacacgaccggtgctcgatttagtagtcgcataaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttca

SEQ ID NO: 550915 - DNA, 444 bp, Homo sapiens; identical to SEQ ID NO: 535027
  misc_feature: HIJSMM301B6YU8.8.73.G07.1.454.light.4.raw

SEQ ID NO: 550916 - DNA, 505 bp, Homo sapiens; identical to SEQ ID NO: 536254
  misc_feature: HIJSMM301BXR3U.7.71.G05.1.454.light.4.raw

SEQ ID NO: 550917 - DNA, 441 bp, Homo sapiens; identical to SEQ ID NO: 534971
  misc_feature: HIJSMM301C48Y9.11.3.A03.1.454.light.4.raw

SEQ ID NO: 550918 - DNA, 493 bp, Homo sapiens
  misc_feature: HIJSMM301ECE9C.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccccggacgttcgtccacgggaccgacggtcggagtgtcagacgacgtagtggcgtgcgaccact

SEQ ID NO: 550919 - DNA, 497 bp, Homo sapiens; identical to SEQ ID NO: 535286
  misc_feature: HIJSMM301C6WG2.18.59.F04.1.454.light.4.raw

SEQ ID NO: 550920 - DNA, 489 bp, Homo sapiens
  misc_feature: HIJSMM301BOGII.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctcg

SEQ ID NO: 550921 - DNA, 447 bp, Homo sapiens; identical to SEQ ID NO: 535201
  misc_feature: HIJSMM301AZJIP.18.9.A09.1.454.light.4.raw

SEQ ID NO: 550922 - DNA, 444 bp, Homo sapiens; identical to SEQ ID NO: 535192
  misc_feature: HIJSMM301ELILT.5.9.A09.1.454.light.4.raw

SEQ ID NO: 550923 - DNA, 504 bp, Homo sapiens
  misc_feature: HIJSMM301DNXLM.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccaccct

SEQ ID NO: 550924 - DNA, 495 bp, Homo sapiens; identical to SEQ ID NO: 543631
  misc_feature: HIJSMM301COB6W.11.59.F04.1.454.light.4.raw

SEQ ID NO: 550925 - DNA, 486 bp, Homo sapiens; identical to SEQ ID NO: 535043
  misc_feature: HIJSMM301CWV4V.46.35.D02.1.454.light.4.raw

SEQ ID NO: 550926 - DNA, 507 bp, Homo sapiens; identical to SEQ ID NO: 545328
  misc_feature: HIJSMM301B3ME1.8.33.C11.1.454.light.4.raw

SEQ ID NO: 550927 - DNA, 484 bp, Homo sapiens; identical to SEQ ID NO: 535400
  misc_feature: HIJSMM301DG0C4.46.26.C04.1.454.light.4.raw

SEQ ID NO: 550928 - DNA, 480 bp, Homo sapiens; identical to SEQ ID NO: 541616
  misc_feature: HIJSMM301C52QB.21.25.C03.1.454.light.4.raw

SEQ ID NO: 550929 - DNA, 455 bp, Homo sapiens; identical to SEQ ID NO: 535447
  misc_feature: HIJSMM301B69L3.19.71.G05.1.454.light.4.raw

SEQ ID NO: 550930 - DNA, 354 bp, Homo sapiens; identical to SEQ ID NO: 540485
  misc_feature: HIJSMM301ENKXP.40.9.A09.1.454.light.4.raw

SEQ ID NO: 550931 - DNA, 510 bp, Homo sapiens; identical to SEQ ID NO: 537801
  misc_feature: HIJSMM301APB26.5.60.F05.1.454.light.4.raw

SEQ ID NO: 550932 - DNA, 496 bp, Homo sapiens
  misc_feature: HIJSMM301BPW7O.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 550933 - DNA, 489 bp, Homo sapiens; identical to SEQ ID NO: 535139
  misc_feature: HIJSMM301C2MK3.14.55.E11.1.454.light.4.raw

SEQ ID NO: 550934 - DNA, 496 bp, Homo sapiens
  misc_feature: HIJSMM301C39AR.49.77.G11.1.454.light.4.raw
agtcgagagacacgaccggtgctcgatttagctagtcactcaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 550935 - DNA, 500 bp, Homo sapiens
  misc_feature: HIJSMM301CK061.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtggaaatacaaacgaactgtggctgcaccta

SEQ ID NO: 550936 - DNA, 505 bp, Homo sapiens
  misc_feature: HIJSMM301C7HEB.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactccctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcta

SEQ ID NO: 550937 - DNA, 415 bp, Homo sapiens
  misc_feature: HIJSMM301E05BK.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgcctcctcgagtagtaca

SEQ ID NO: 550938 - DNA, 454 bp, Homo sapiens; identical to SEQ ID NO: 534964
  misc_feature: HIJSMM301DITUO.19.86.H09.1.454.light.4.raw

SEQ ID NO: 550939 - DNA, 448 bp, Homo sapiens
  misc_feature: HIJSMM301BGWJM.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactagtttgggtgtttgggtgttcggcggagggaccaagctgaccgtcctaagtcagcccaaggctcgccccctcggtccactctcgttcccaccctcctccgtgtctgat

SEQ ID NO: 550940 - DNA, 502 bp, Homo sapiens
  misc_feature: HIJSMM301EIXDZ.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagtattcttcttaccctcggacgttcggtccgacgggaccgacggtcggagtgtacaagacgaacgtgtggtcgtcggcaccactcttcg

SEQ ID NO: 550941 - DNA, 513 bp, Homo sapiens
  misc_feature: HIJSMM301DHJE6.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagattttcactctcaccatcagcagcctgcaggctgaagatgtggcagtttattattgtcaacaatatattatacttcgtggacgttcggtccgaagggaccgaaacggtagggtagtattacagacgaaaaccgtgtgggctgg

SEQ ID NO: 550942 - DNA, 480 bp, Homo sapiens
  misc_feature: HIJSMM301D5X5T.40.83.H06.1.454.light.4.raw
tctagcgactcacgaccggtgctcgatttagatcacgtgcgtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacgttcgccaggaaccgaaggtaggaatacaaacgaactagtggctgcacca

SEQ ID NO: 550943 - DNA, 447 bp, Homo sapiens; identical to SEQ ID NO: 541817
  misc_feature: HIJSMM301CTYQQ.18.9.A09.1.454.light.4.raw

SEQ ID NO: 550944 - DNA, 504 bp, Homo sapiens
  misc_feature: HIJSMM301D2DOV.5.24.C02.1.454.light.4.raw
  modified_base (448)..(448): a, c, t, g, unknown or other
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatntgatcttcggcgggggaccaagctgaccgtcctaggtcagcccaaggctgcccccc

SEQ ID NO: 550945 - DNA, 444 bp, Homo sapiens; identical to SEQ ID NO: 535192
  misc_feature: HIJSMM301D0PTG.5.9.A09.1.454.light.4.raw

SEQ ID NO: 550946 - DNA, 511 bp, Homo sapiens
  misc_feature: HIJSMM301D70XA.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctggtcactctgttccc

SEQ ID NO: 550947 - DNA, 495 bp, Homo sapiens
  misc_feature: HIJSMM301C501X.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggaggccgaccaagtcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtggc

SEQ ID NO: 550948 - DNA, 504 bp, Homo sapiens
  misc_feature: HIJSMM301EC14J.48.70.G04.1.454.light.4.raw
agtatacatacacgaccggtgctcgatttagtgtagtgtgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccgaaggaccgaacggtggaaagtacaaacgaacctagtggctggcacca

SEQ ID NO: 550949 - DNA, 478 bp, Homo sapiens; identical to SEQ ID NO: 541545
  misc_feature: HIJSMM301BPMD3.10.74.G08.1.454.light.4.raw

SEQ ID NO: 550950 - DNA, 441 bp, Homo sapiens; identical to SEQ ID NO: 534971
  misc_feature: HIJSMM301C4LZY.11.3.A03.1.454.light.4.raw

SEQ ID NO: 550951 - DNA, 491 bp, Homo sapiens
  misc_feature: HIJSMM301EJYHZ.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcaattttggccaggggaccaaactggatatcagacgaactgtggctgca

SEQ ID NO: 550952 - DNA, 489 bp, Homo sapiens
  misc_feature: HIJSMM301EIV6B.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtgctgcacatctgtcttcatcttcccgccat

SEQ ID NO: 550953 - DNA, 520 bp, Homo sapiens
  misc_feature: HIJSMM301BMBGZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaaggtaggaaggtacgaaacgaacgtagtggcgtgcaccactctgtcttctactcttcccgtccctact

SEQ ID NO: 550954 - DNA, 496 bp, Homo sapiens; identical to SEQ ID NO: 535109
  misc_feature: HIJSMM301AVLIB.16.78.H01.1.454.light.4.raw

SEQ ID NO: 550955 - DNA, 460 bp, Homo sapiens; identical to SEQ ID NO: 537107
  misc_feature: HIJSMM301AIXBR.22.28.C06.1.454.light.4.raw

SEQ ID NO: 550956 - DNA, 482 bp, Homo sapiens; identical to SEQ ID NO: 550464
  misc_feature: HIJSMM301C8F15.13.50.E06.1.454.light.4.raw

SEQ ID NO: 550957 - DNA, 474 bp, Homo sapiens
  misc_feature: HIJSMM301D62ES.8.85.H08.1.454.light.4.raw
ctcgcgtgtccacgaccggtgctcgatttagtatcactcagtcggcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgccctaagctcctcatatattctgcattcactttgcaaagtggggtcccatcaaggttcagtggcagtggatctgggacagatttcactctcaccatccgcagtctgcaacctgaagatttgcaatttattactgtcaagagactcacaatgaggcacttttggccaggggaccaagctggagaggaacgaactgtggctgcaccat

SEQ ID NO: 550958 - DNA, 498 bp, Homo sapiens
  misc_feature: HIJSMM301A1MCQ.48.33.C11.1.454.light.4.raw
agtatacatacacgaccggtgctcgatttagagtgagctcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 550959 - DNA, 486 bp, Homo sapiens; identical to SEQ ID NO: 535458
  misc_feature: HIJSMM301AXN5J.7.75.G09.1.454.light.4.raw

SEQ ID NO: 550960 - DNA, 486 bp, Homo sapiens; identical to SEQ ID NO: 535043
  misc_feature: HIJSMM301BM09R.46.35.D02.1.454.light.4.raw

SEQ ID NO: 550961 - DNA, 493 bp, Homo sapiens; identical to SEQ ID NO: 535047
  misc_feature: HIJSMM301EREX7.16.53.E09.1.454.light.4.raw

SEQ ID NO: 550962 - DNA, 515 bp, Homo sapiens
  misc_feature: HIJSMM301C6QUW.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctcgccccctcggtcactctgttccccg

SEQ ID NO: 550963 - DNA, 484 bp, Homo sapiens; identical to SEQ ID NO: 535211
  misc_feature: HIJSMM301B4IJT.47.46.E02.1.454.light.4.raw

SEQ ID NO: 550964 - DNA, 486 bp, Homo sapiens; identical to SEQ ID NO: 535043
  misc_feature: HIJSMM301D6JHE.46.35.D02.1.454.light.4.raw

SEQ ID NO: 550965 - DNA, 504 bp, Homo sapiens; identical to SEQ ID NO: 538681
  misc_feature: HIJSMM301AFT0H.7.71.G05.1.454.light.4.raw

SEQ ID NO: 550966 - DNA, 451 bp, Homo sapiens
  misc_feature: HIJSMM301BHR9V.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccaccctccccacagagta

SEQ ID NO: 550967 - DNA, 502 bp, Homo sapiens
  misc_feature: HIJSMM301AJ2FR.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagtccaaggctgccccctc

SEQ ID NO: 550968 - DNA, 495 bp, Homo sapiens
  misc_feature: HIJSMM301BTJ9U.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatcaaacgaactgtggctgcaccatctgtcttca

SEQ ID NO: 550969 - DNA, 518 bp, Homo sapiens; identical to SEQ ID NO: 539372
  misc_feature: HIJSMM301B33OC.7.86.H09.1.454.light.4.raw

SEQ ID NO: 550970 - DNA, 463 bp, Homo sapiens; identical to SEQ ID NO: 535062
  misc_feature: HIJSMM301AN56X.11.73.G07.1.454.light.4.raw

SEQ ID NO: 550971 - DNA, 501 bp, Homo sapiens
  misc_feature: HIJSMM301BMZOC.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaactgtggctgcaccta

SEQ ID NO: 550972 - DNA, 502 bp, Homo sapiens
  misc_feature: HIJSMM301BG5L4.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggccaagctgaccgtcctgggtcagcccaaggctgccccctcggtcta

SEQ ID NO: 550973 - DNA, 421 bp, Homo sapiens
  misc_feature: HIJSMM301EBV9L.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggcgtccaggctgaggacgaggctgattattactgcagctcatatacaagcaccagcactctctatgtcttcggaactgggaccaaggtcaccgtcctaggtcagcccaacggccaaaccccactgtcactctgttcccaccctctccatactcgta

SEQ ID NO: 550974 - DNA, 477 bp, Homo sapiens
  misc_feature: HIJSMM301EO12I.4.33.C11.1.454.light.4.raw
agcactgtagcacgaccggtgctcgatttagagtgagctcgttgggtttggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaatcaaacgaactgtggctgcaca

SEQ ID NO: 550975 - DNA, 487 bp, Homo sapiens; identical to SEQ ID NO: 537220
  misc_feature: HIJSMM301DRDBZ.16.53.E09.1.454.light.4.raw

SEQ ID NO: 550976 - DNA, 505 bp, Homo sapiens
  misc_feature: HIJSMM301BO5FO.5.24.C02.1.454.light.4.raw
atcagacacgcacgaccggtgctcgatttagtacagatcgttagggaaaggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtatctgggctccaggctgaggatgaggctgattattactgcagctcatatgcaggcagcagcagtccccatgtgatcttcggcgggggaccaagctgaccgtcctagtcagcccaaggctcgccccccg

SEQ ID NO: 550977 - DNA, 498 bp, Homo sapiens; identical to SEQ ID NO: 536896
  misc_feature: HIJSMM301B6GSO.48.34.D01.1.454.light.4.raw

SEQ ID NO: 550978 - DNA, 485 bp, Homo sapiens; identical to SEQ ID NO: 536630
  misc_feature: HIJSMM301ER24Y.13.56.F01.1.454.light.4.raw

SEQ ID NO: 550979 - DNA, 504 bp, Homo sapiens; identical to SEQ ID NO: 549905
  misc_feature: HIJSMM301ASMII.48.71.G05.1.454.light.4.raw

SEQ ID NO: 550980 - DNA, 497 bp, Homo sapiens; identical to SEQ ID NO: 535664
  misc_feature: HIJSMM301EHGSB.22.14.B03.1.454.light.4.raw

SEQ ID NO: 550981 - DNA, 497 bp, Homo sapiens; identical to SEQ ID NO: 535664
  misc_feature: HIJSMM301BCGRT.22.14.B03.1.454.light.4.raw

SEQ ID NO: 550982 - DNA, 504 bp, Homo sapiens; identical to SEQ ID NO: 536469
  misc_feature: HIJSMM301EEOJ0.52.36.D03.1.454.light.4.raw

SEQ ID NO: 550983 - DNA, 497 bp, Homo sapiens; identical to SEQ ID NO: 536371
  misc_feature: HIJSMM301DBJQQ.16.78.H01.1.454.light.4.raw

SEQ ID NO: 550984 - DNA, 504 bp, Homo sapiens
  misc_feature: HIJSMM301B8BSI.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcacatctgt

SEQ ID NO: 550985 - DNA, 500 bp, Homo sapiens
  misc_feature: HIJSMM301BC7F2.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaaccttcggccaaggaacacgaactggagattaaaggaaactagtggctgcaccaatctgtcttcactcttccccg

SEQ ID NO: 550986 - DNA, 494 bp, Homo sapiens; identical to SEQ ID NO: 534992
  misc_feature: HIJSMM301CZWPK.9.1.A01.1.454.light.4.raw

SEQ ID NO: 550987 - DNA, 492 bp, Homo sapiens; identical to SEQ ID NO: 535126
  misc_feature: HIJSMM301B4X4T.18.11.A11.1.454.light.4.raw

SEQ ID NO: 550988 - DNA, 497 bp, Homo sapiens
  misc_feature: HIJSMM301AETV2.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaacgggaccgaacggtaggaatacaaccgaactgtggctgcaccatctgtcttctat

SEQ ID NO: 550989 - DNA, 470 bp, Homo sapiens
  misc_feature: HIJSMM301EJXHP.52.59.F04.1.454.light.4.raw
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaactttattttctgtcataactatgatgatgcccctcacacgttcggccaagggaccaagctggaaatcaaacgaa

SEQ ID NO: 550990 - DNA, 420 bp, Homo sapiens; identical to SEQ ID NO: 540533
  misc_feature: HIJSMM301CHSGK.9.34.D01.1.454.light.4.raw

SEQ ID NO: 550991 - DNA, 485 bp, Homo sapiens
  misc_feature: HIJSMM301A0QQI.47.46.E02.1.454.light.4.raw
  modified_base (198)..(198): a, c, t, g, unknown or other
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 550992 - DNA, 488 bp, Homo sapiens
  misc_feature: HIJSMM301EY15Z.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggcgaccagtcaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 550993 - DNA, 494 bp, Homo sapiens; identical to SEQ ID NO: 536444
  misc_feature: HIJSMM301EFNTB.26.72.G06.1.454.light.4.raw

SEQ ID NO: 550994 - DNA, 506 bp, Homo sapiens
  misc_feature: HIJSMM301BTM02.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgtcccgccctccc

SEQ ID NO: 550995 - DNA, 491 bp, Homo sapiens; identical to SEQ ID NO: 537567
  misc_feature: HIJSMM301CH2FP.48.38.D05.1.454.light.4.raw

SEQ ID NO: 550996 - DNA, 477 bp, Homo sapiens
  misc_feature: HIJSMM301A3RE4.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcagtatcatgactggccgctcaccttcggccaagggacacgactggagattaaacgaactgtgg

SEQ ID NO: 550997 - DNA, 488 bp, Homo sapiens; identical to SEQ ID NO: 538811
  misc_feature: HIJSMM301DD2Y9.40.83.H06.1.454.light.4.raw

SEQ ID NO: 550998 - DNA, 495 bp, Homo sapiens
  misc_feature: HIJSMM301EOW2J.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtccaggggaccaagctggagatcaaacgaactgtggc

SEQ ID NO: 550999 - DNA, 505 bp, Homo sapiens
  misc_feature: HIJSMM301DHK11.49.65.F10.1.454.light.4.raw
agtcgagagacacgaccggtgctcgatttagctacgctctaaggggctggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacct

SEQ ID NO: 551000 - DNA, 495 bp, Homo sapiens; identical to SEQ ID NO: 535007
  misc_feature: HIJSMM301D5TKE.22.5.A05.1.454.light.4.raw

SEQ ID NO: 551001 - DNA, 494 bp, Homo sapiens
  misc_feature: HIJSMM301D1R1X.4.27.C05.1.454.light.4.raw
agcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcaggggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcact

SEQ ID NO: 551002 - DNA, 494 bp, Homo sapiens
  misc_feature: HIJSMM301CXIG5.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgcttcggaactgggaccaaggtcaccgtcctaggtcagcccaaggccaacccatgtcactctgttccccgcctcctcgagtagtaca

SEQ ID NO: 551003 - DNA, 463 bp, Homo sapiens; identical to SEQ ID NO: 535062
  misc_feature: HIJSMM301ADG0B.11.73.G07.1.454.light.4.raw

SEQ ID NO: 551004 - DNA, 480 bp, Homo sapiens
  misc_feature: HIJSMM301DMLRU.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccaggtggaatacaaacgaactagtggctgcaccat

SEQ ID NO: 551005 - DNA, 494 bp, Homo sapiens; identical to SEQ ID NO: 534994
  misc_feature: HIJSMM301EB9TL.27.78.H01.1.454.light.4.raw

SEQ ID NO: 551006 - DNA, 492 bp, Homo sapiens
  misc_feature: HIJSMM301D32J1.41.16.B05.1.454.light.4.raw
tctatactatcacgaccggtgctcgatttagagctcacgtaagggggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgaactgtggctgcaccatctgtcttcatcttcccgcc

SEQ ID NO: 551007 - DNA, 509 bp, Homo sapiens
  misc_feature: HIJSMM301CC6TM.13.53.E09.1.454.light.4.raw
  modified_base (487)..(487): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaaggtacggaagtacaagacgaactacgtggctgcnccatctgtcttctatcttccgt

SEQ ID NO: 551008 - DNA, 485 bp, Homo sapiens; identical to SEQ ID NO: 536075
  misc_feature: HIJSMM301BFLLN.17.21.B10.1.454.light.4.raw

SEQ ID NO: 551009 - DNA, 486 bp, Homo sapiens
  misc_feature: HIJSMM301C756X.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctccctcgctacgtaga

SEQ ID NO: 551010 - DNA, 489 bp, Homo sapiens; identical to SEQ ID NO: 537328
  misc_feature: HIJSMM301D996R.13.5.A05.1.454.light.4.raw

SEQ ID NO: 551011 - DNA, 485 bp, Homo sapiens
  misc_feature: HIJSMM301EBLAW.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaataccctcggctcactttcggcggagggaccaaggtggagatcaaacgaactgtggctgcaccta

SEQ ID NO: 551012 - DNA, 449 bp, Homo sapiens
  misc_feature: HIJSMM301A1BDI.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgacctattactgccagtcctatgacatgaggctgagtggttcgtatgtcttcggatctgggaccaaggtcaccgtcctaagtcagcccaaggccaacccctctgtcactctgttcccaccctcctccactactcgta

SEQ ID NO: 551013 - DNA, 486 bp, Homo sapiens; identical to SEQ ID NO: 535043
  misc_feature: HIJSMM301CUTWR.46.35.D02.1.454.light.4.raw

SEQ ID NO: 551014 - DNA, 516 bp, Homo sapiens
  misc_feature: HIJSMM301DMXQF.9.86.H09.1.454.light.4.raw
tgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctggtcactctgttcccacctcct

SEQ ID NO: 551015 - DNA, 519 bp, Homo sapiens
  misc_feature: HIJSMM301CIQC2.48.61.F06.1.454.light.4.raw
agtatacatacacgaccggtgctcgatttagctacgctctaagggaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccgggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcctcct

SEQ ID NO: 551016 - DNA, 500 bp, Homo sapiens; identical to SEQ ID NO: 539795
  misc_feature: HIJSMM301D4Z3I.22.38.D05.1.454.light.4.raw

SEQ ID NO: 551017 - DNA, 485 bp, Homo sapiens; identical to SEQ ID NO: 536723
  misc_feature: HIJSMM301BKXQ2.5.40.D07.1.454.light.4.raw

SEQ ID NO: 551018 - DNA, 501 bp, Homo sapiens
  misc_feature: HIJSMM301CIHV2.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaacgacccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccaccctcctctgtcgagcgt

SEQ ID NO: 551019 - DNA, 490 bp, Homo sapiens
  misc_feature: HIJSMM301CB40H.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 551020 - DNA, 500 bp, Homo sapiens; identical to SEQ ID NO: 540012
  misc_feature: HIJSMM301BXQIZ.52.34.D01.1.454.light.4.raw

SEQ ID NO: 551021 - DNA, 492 bp, Homo sapiens; identical to SEQ ID NO: 536249
  misc_feature: HIJSMM301D5DK6.49.68.G02.1.454.light.4.raw

SEQ ID NO: 551022 - DNA, 497 bp, Homo sapiens
  misc_feature: HIJSMM301A2ILR.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaaactgtggctgcaccatctgtcttctat

SEQ ID NO: 551023 - DNA, 497 bp, Homo sapiens
  misc_feature: HIJSMM301CEWBN.51.23.C01.1.454.light.4.raw
cgatcgtatacacgaccggtgctcgatttagtacacgtgattagggattggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctggcgattttcggcggagggaccagtctgaccgtcctaggtcagcccaaggctgccccctcggtcactc

SEQ ID NO: 551024 - DNA, 491 bp, Homo sapiens
  misc_feature: HIJSMM301BLI6F.49.60.F05.1.454.light.4.raw
agtcgagagacacgaccggtgctcgatttagtacgtcatcagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaaatcagcagagtggaggctgacgatattggggtttattactgcatgcaagcaatacaccgcctcactttcggcggagggaccacactggagatcaaacgaactgtggctgcacc

SEQ ID NO: 551025 - DNA, 499 bp, Homo sapiens
  misc_feature: HIJSMM301CBA94.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccacct

SEQ ID NO: 551026 - DNA, 447 bp, Homo sapiens; identical to SEQ ID NO: 535020
  misc_feature: HIJSMM301AE2CP.18.9.A09.1.454.light.4.raw

SEQ ID NO: 551027 - DNA, 502 bp, Homo sapiens; identical to SEQ ID NO: 543913
  misc_feature: HIJSMM301CCICP.18.26.C04.1.454.light.4.raw

SEQ ID NO: 551028 - DNA, 493 bp, Homo sapiens
  misc_feature: HIJSMM301CWBR1.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctggtcagcccaaggctgccccctcggtcact

SEQ ID NO: 551029 - DNA, 484 bp, Homo sapiens
  misc_feature: HIJSMM301BVD1D.52.67.G01.1.454.light.4.raw
cgcagtacgacacgaccggtgctcgatttagagtatacatattgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 551030 - DNA, 486 bp, Homo sapiens; identical to SEQ ID NO: 535043
  misc_feature: HIJSMM301APBJL.46.35.D02.1.454.light.4.raw

SEQ ID NO: 551031 - DNA, 488 bp, Homo sapiens
  misc_feature: HIJSMM301CYEE5.47.28.C06.1.454.light.4.raw
agctcacgtacacgaccggtgctcgatttagagctcacgtattgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggccaggggaccaagctggagatcaaacgaa

SEQ ID NO: 551032 - DNA, 454 bp, Homo sapiens; identical to SEQ ID NO: 536449
  misc_feature: HIJSMM301A1EB9.18.78.H01.1.454.light.4.raw

SEQ ID NO: 551033 - DNA, 443 bp, Homo sapiens
  misc_feature: HIJSMM301CM8DK.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtactagacg

SEQ ID NO: 551034 - DNA, 457 bp, Homo sapiens
  misc_feature: HIJSMM301BB1TO.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaacagggtcccatcaaggttcagtggaagtggctctgggacagattttacttcaccatcagcaggctgcagcctgaagatattgcaacatattactgtcaacagtatgatagtctccgctcactttcggcgggggaccaaggtggagatccagcgaa

SEQ ID NO: 551035 - DNA, 464 bp, Homo sapiens; identical to SEQ ID NO: 536640
  misc_feature: HIJSMM301ALFGN.26.78.H01.1.454.light.4.raw

SEQ ID NO: 551036 - DNA, 446 bp, Homo sapiens; identical to SEQ ID NO: 537330
  misc_feature: HIJSMM301C38L4.18.9.A09.1.454.light.4.raw

SEQ ID NO: 551037 - DNA, 502 bp, Homo sapiens
  misc_feature: HIJSMM301C9L8K.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatctgtcttcatt

SEQ ID NO: 551038 - DNA, 490 bp, Homo sapiens; identical to SEQ ID NO: 536481
  misc_feature: HIJSMM301B2J8X.13.46.E02.1.454.light.4.raw

SEQ ID NO: 551039 - DNA, 503 bp, Homo sapiens
  misc_feature: HIJSMM301B8ESR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccaaggtggaaatcaaacgaactgtggctgcaccatctgtcttcatcttccccg

SEQ ID NO: 551040 - DNA, 440 bp, Homo sapiens
  misc_feature: HIJSMM301DNTEN.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctgttcctgccctcctcatagtataga

SEQ ID NO: 551041 - DNA, 506 bp, Homo sapiens; identical to SEQ ID NO: 535058
  misc_feature: HIJSMM301DQAFA.17.41.D08.1.454.light.4.raw

SEQ ID NO: 551042 - DNA, 504 bp, Homo sapiens
  misc_feature: HIJSMM301DVELP.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaaggtggagatcaaacgaactgtggctgcaccatctgtcttcatcttcccgcc

SEQ ID NO: 551043 - DNA, 495 bp, Homo sapiens
  misc_feature: HIJSMM301AMM1Y.43.34.D01.1.454.light.4.raw
tgtgagtagtcacgaccggtgctcgatttagatcgtctgtgttgggtttgggtggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaagtagcagtgacgttggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctcg

SEQ ID NO: 551044 - DNA, 479 bp, Homo sapiens; identical to SEQ ID NO: 537349
  misc_feature: HIJSMM301BUUES.48.28.C06.1.454.light.4.raw

SEQ ID NO: 551045 - DNA, 492 bp, Homo sapiens
  misc_feature: HIJSMM301C9UOQ.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccgaaggtggaagtcaaacgaactgtggctgcaccatctgtctt

SEQ ID NO: 551046 - DNA, 480 bp, Homo sapiens
  misc_feature: HIJSMM301A6OJH.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgggactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtcttca

SEQ ID NO: 551047 - DNA, 495 bp, Homo sapiens; identical to SEQ ID NO: 535596
  misc_feature: HIJSMM301C80TP.10.79.H02.1.454.light.4.raw

SEQ ID NO: 551048 - DNA, 488 bp, Homo sapiens; identical to SEQ ID NO: 535990
  misc_feature: HIJSMM301BMAIK.11.28.C06.1.454.light.4.raw

SEQ ID NO: 551049 - DNA, 493 bp, Homo sapiens; identical to SEQ ID NO: 536969
  misc_feature: HIJSMM301DPS4Q.27.78.H01.1.454.light.4.raw

SEQ ID NO: 551050 - DNA, 494 bp, Homo sapiens; identical to SEQ ID NO: 534992
  misc_feature: HIJSMM301AO0L5.9.1.A01.1.454.light.4.raw

SEQ ID NO: 551051 - DNA, 503 bp, Homo sapiens
  misc_feature: HIJSMM301A81XK.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgtcgtaacgacgaacgtacgtggtcgtcggcaccactcttcg

SEQ ID NO: 551052 - DNA, 500 bp, Homo sapiens; identical to SEQ ID NO: 539795
  misc_feature: HIJSMM301E0PR9.22.38.D05.1.454.light.4.raw

SEQ ID NO: 551053 - DNA, 455 bp, Homo sapiens
  misc_feature: HIJSMM301BGLFO.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccgaccctcctccacgagagta

SEQ ID NO: 551054 - DNA, 505 bp, Homo sapiens; identical to SEQ ID NO: 536254
  misc_feature: HIJSMM301EL3H4.7.71.G05.1.454.light.4.raw

SEQ ID NO: 551055 - DNA, 485 bp, Homo sapiens
  misc_feature: HIJSMM301DRNRH.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgctaacttattactgccagcagtataatgattaccctatcaccttcggccggggacacggctggaaactaacgaactgtggctgcacca

SEQ ID NO: 551056 - DNA, 494 bp, Homo sapiens; identical to SEQ ID NO: 534992
  misc_feature: HIJSMM301EQWJR.9.1.A01.1.454.light.4.raw

SEQ ID NO: 551057 - DNA, 486 bp, Homo sapiens; identical to SEQ ID NO: 535043
  misc_feature: HIJSMM301EKITS.46.35.D02.1.454.light.4.raw

SEQ ID NO: 551058 - DNA, 510 bp, Homo sapiens; identical to SEQ ID NO: 535474
  misc_feature: HIJSMM301APMX5.17.33.C11.1.454.light.4.raw

SEQ ID NO: 551059 - DNA, 441 bp, Homo sapiens
  misc_feature: HIJSMM301BWTCO.11.3.A03.1.454.light.4.raw
  modified_base (423)..(423): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccnccctcctcgtatctctcg

SEQ ID NO: 551060 - DNA, 504 bp, Homo sapiens
  misc_feature: HIJSMM301D4X8V.13.23.C01.1.454.light.4.raw
tcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaagg

SEQ ID NO: 551061 - DNA, 495 bp, Homo sapiens; identical to SEQ ID NO: 549785
  misc_feature: HIJSMM301C8ZYY.12.38.D05.1.454.light.4.raw

SEQ ID NO: 551062 - DNA, 509 bp, Homo sapiens; identical to SEQ ID NO: 535670
  misc_feature: HIJSMM301DTUPV.47.23.C01.1.454.light.4.raw

SEQ ID NO: 551063 - DNA, 482 bp, Homo sapiens
  misc_feature: HIJSMM301ERL6R.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggtcggcgggacc

SEQ ID NO: 551064 - DNA, 513 bp, Homo sapiens
  misc_feature: HIJSMM301EFXHH.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcggagtcgctaggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactcctgttcccgctctcct

SEQ ID NO: 551065 - DNA, 501 bp, Homo sapiens; identical to SEQ ID NO: 542488
  misc_feature: HIJSMM301D4KL9.19.78.H01.1.454.light.4.raw

SEQ ID NO: 551066 - DNA, 494 bp, Homo sapiens
  misc_feature: HIJSMM301BD2I2.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaagg

SEQ ID NO: 551067 - DNA, 507 bp, Homo sapiens
  misc_feature: HIJSMM301BXQUO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagtctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtggaaagtacaaacgaactagtggctgcaccatctgtcttcatcttccccg

SEQ ID NO: 551068 - DNA, 499 bp, Homo sapiens
  misc_feature: HIJSMM301B2QZU.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactg

SEQ ID NO: 551069 - DNA, 486 bp, Homo sapiens; identical to SEQ ID NO: 535043
  misc_feature: HIJSMM301BL4JE.46.35.D02.1.454.light.4.raw

SEQ ID NO: 551070 - DNA, 463 bp, Homo sapiens; identical to SEQ ID NO: 535062
  misc_feature: HIJSMM301B47TP.11.73.G07.1.454.light.4.raw

SEQ ID NO: 551071 - DNA, 489 bp, Homo sapiens; identical to SEQ ID NO: 535139
  misc_feature: HIJSMM301ES772.14.55.E11.1.454.light.4.raw

SEQ ID NO: 551072 - DNA, 520 bp, Homo sapiens; identical to SEQ ID NO: 535773
  misc_feature: HIJSMM301CQEDY.41.19.B08.1.454.light.4.raw

SEQ ID NO: 551073 - DNA, 499 bp, Homo sapiens; identical to SEQ ID NO: 544072
  misc_feature: HIJSMM301CRK2Z.48.30.C08.1.454.light.4.raw

SEQ ID NO: 551074 - DNA, 465 bp, Homo sapiens; identical to SEQ ID NO: 547826
  misc_feature: HIJSMM301A29LN.11.70.G04.1.454.light.4.raw

SEQ ID NO: 551075 - DNA, 465 bp, Homo sapiens
  misc_feature: HIJSMM301D9LY3.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcgagggaccaaggtggagatcaaacgaa

SEQ ID NO: 551076 - DNA, 481 bp, Homo sapiens; identical to SEQ ID NO: 535993
  misc_feature: HIJSMM301A7LCM.21.25.C03.1.454.light.4.raw

SEQ ID NO: 551077 - DNA, 487 bp, Homo sapiens
  misc_feature: HIJSMM301BY7PV.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccgaaggttggagatacaaacgaaactgtggcgt

SEQ ID NO: 551078 - DNA, 493 bp, Homo sapiens; identical to SEQ ID NO: 539202
  misc_feature: HIJSMM301AG619.22.57.F02.1.454.light.4.raw

SEQ ID NO: 551079 - DNA, 494 bp, Homo sapiens; identical to SEQ ID NO: 541400
  misc_feature: HIJSMM301DX8W8.51.71.G05.1.454.light.4.raw

SEQ ID NO: 551080 - DNA, 493 bp, Homo sapiens; identical to SEQ ID NO: 535047
  misc_feature: HIJSMM301AT9FO.16.53.E09.1.454.light.4.raw

SEQ ID NO: 551081 - DNA, 493 bp, Homo sapiens
  misc_feature: HIJSMM301EPOX4.52.14.B03.1.454.light.4.raw
cgcagtacgacacgaccggtgctcgatttagtgtgagtagttccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcact

SEQ ID NO: 551082 - DNA, 486 bp, Homo sapiens; identical to SEQ ID NO: 535043
  misc_feature: HIJSMM301BSJ9D.46.35.D02.1.454.light.4.raw

SEQ ID NO: 551083 - DNA, 487 bp, Homo sapiens; identical to SEQ ID NO: 538190
  misc_feature: HIJSMM301A3RDI.47.70.G04.1.454.light.4.raw

SEQ ID NO: 551084 - DNA, 503 bp, Homo sapiens
  misc_feature: HIJSMM301C6LKM.48.26.C04.1.454.light.4.raw
agtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 551085 - DNA, 494 bp, Homo sapiens; identical to SEQ ID NO: 534992
  misc_feature: HIJSMM301C77XK.9.1.A01.1.454.light.4.raw

SEQ ID NO: 551086 - DNA, 502 bp, Homo sapiens
  misc_feature: HIJSMM301DL6AI.48.67.G01.1.454.light.4.raw
agtatacatacacgaccggtgctcgatttagagtatacatattgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaaggctgaccgtcctaaagtcagcccaaggctgccccctcggtcta

SEQ ID NO: 551087 - DNA, 504 bp, Homo sapiens; identical to SEQ ID NO: 535561
  misc_feature: HIJSMM301B5FD3.4.57.F02.1.454.light.4.raw

SEQ ID NO: 551088 - DNA, 494 bp, Homo sapiens; identical to SEQ ID NO: 534994
  misc_feature: HIJSMM301CBYXC.27.78.H01.1.454.light.4.raw

SEQ ID NO: 551089 - DNA, 486 bp, Homo sapiens; identical to SEQ ID NO: 535523
  misc_feature: HIJSMM301D8C48.22.73.G07.1.454.light.4.raw

SEQ ID NO: 551090 - DNA, 482 bp, Homo sapiens
  misc_feature: HIJSMM301DQIRJ.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtca

SEQ ID NO: 551091 - DNA, 485 bp, Homo sapiens; identical to SEQ ID NO: 538956
  misc_feature: HIJSMM301DLI8W.40.69.G03.1.454.light.4.raw

SEQ ID NO: 551092 - DNA, 491 bp, Homo sapiens
  misc_feature: HIJSMM301C02WC.51.71.G05.1.454.light.4.raw
cgatcgtatacacgaccggtgctcgatttagtgtcgtcgcaagagagagggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 551093 - DNA, 493 bp, Homo sapiens
  misc_feature: HIJSMM301ESCP4.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaacgaact

SEQ ID NO: 551094 - DNA, 493 bp, Homo sapiens; identical to SEQ ID NO: 535657
  misc_feature: HIJSMM301CJC0J.27.78.H01.1.454.light.4.raw

SEQ ID NO: 551095 - DNA, 519 bp, Homo sapiens
  misc_feature: HIJSMM301B3AOE.48.37.D04.1.454.light.4.raw
agtatacatacacgaccggtgctcgatttagtagcatactgttgggtttgggatttagatcgtctgtgttgggtttgggcttgatgccttggggtgggaggagagacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 551096 - DNA, 505 bp, Homo sapiens; identical to SEQ ID NO: 540309
  misc_feature: HIJSMM301EC6LS.5.68.G02.1.454.light.4.raw

SEQ ID NO: 551097 - DNA, 504 bp, Homo sapiens
  misc_feature: HIJSMM301DYV28.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtctaggtcagcccaaggcagccccctcggtcact

SEQ ID NO: 551098 - DNA, 503 bp, Homo sapiens; identical to SEQ ID NO: 539976
  misc_feature: HIJSMM301CZJYB.47.55.E11.1.454.light.4.raw

SEQ ID NO: 551099 - DNA, 508 bp, Homo sapiens
  misc_feature: HIJSMM301ARKIU.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccact

SEQ ID NO: 551100 - DNA, 486 bp, Homo sapiens; identical to SEQ ID NO: 535917
  misc_feature: HIJSMM301AJCQW.3.10.A10.1.454.light.4.raw

SEQ ID NO: 551101 - DNA, 489 bp, Homo sapiens
  misc_feature: HIJSMM301C1KWV.17.35.D02.1.454.light.4.raw
cgtagactagcacgaccggtgctcgatttagcacacgatagttgggtttggggagtcagacccagtcaggacacagcatggacatgagggtccccgctcagctcctggggctcctgctgctctggctcccaggtgccagatggtgacatccgagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtctt

SEQ ID NO: 551102 - DNA, 502 bp, Homo sapiens; identical to SEQ ID NO: 536604
  misc_feature: HIJSMM301AP28W.27.78.H01.1.454.light.4.raw

SEQ ID NO: 551103 - DNA, 505 bp, Homo sapiens
  misc_feature: HIJSMM301C0KUR.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtcg

SEQ ID NO: 551104 - DNA, 497 bp, Homo sapiens
  misc_feature: HIJSMM301ERK9V.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagtcaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 551105 - DNA, 506 bp, Homo sapiens
  misc_feature: HIJSMM301D7HLF.16.49.E05.1.454.light.4.raw
tgtactactccacgaccggtgctcgatttagagcgactagcaacacacaaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtggaccgtcctaggtcagcccaaggctgtccccccg

SEQ ID NO: 551106 - DNA, 514 bp, Homo sapiens
  misc_feature: HIJSMM301DJELK.8.28.C06.1.454.light.4.raw
ctcgcgtgtccacgaccggtgctcgatttagagctcacgtattgggtttgggggaggaactgctcagttaggacccagacggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaggtggaggatcaaacgaacctagtggctgcaccactctgtcttcta

SEQ ID NO: 551107 - DNA, 491 bp, Homo sapiens
  misc_feature: HIJSMM301EN5EE.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactagtggctgcaccatctgtcttcatt

SEQ ID NO: 551108 - DNA, 503 bp, Homo sapiens; identical to SEQ ID NO: 547049
  misc_feature: HIJSMM301A28JE.18.59.F04.1.454.light.4.raw

SEQ ID NO: 551109 - DNA, 472 bp, Homo sapiens; identical to SEQ ID NO: 545405
  misc_feature: HIJSMM301AHK6Z.3.38.D05.1.454.light.4.raw

SEQ ID NO: 551110 - DNA, 455 bp, Homo sapiens
  misc_feature: HIJSMM301DG77E.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgacgagta

SEQ ID NO: 551111 - DNA, 503 bp, Homo sapiens; identical to SEQ ID NO: 537189
  misc_feature: HIJSMM301EIID0.19.85.H08.1.454.light.4.raw

SEQ ID NO: 551112 - DNA, 483 bp, Homo sapiens; identical to SEQ ID NO: 542200
  misc_feature: HIJSMM301C0BDD.7.75.G09.1.454.light.4.raw

SEQ ID NO: 551113 - DNA, 492 bp, Homo sapiens; identical to SEQ ID NO: 536010
  misc_feature: HIJSMM301BAXVV.10.20.B09.1.454.light.4.raw

SEQ ID NO: 551114 - DNA, 505 bp, Homo sapiens; identical to SEQ ID NO: 550097
  misc_feature: HIJSMM301D1ILA.7.71.G05.1.454.light.4.raw

SEQ ID NO: 551115 - DNA, 465 bp, Homo sapiens; identical to SEQ ID NO: 549885
  misc_feature: HIJSMM301AS55S.11.70.G04.1.454.light.4.raw

SEQ ID NO: 551116 - DNA, 492 bp, Homo sapiens; identical to SEQ ID NO: 545637
  misc_feature: HIJSMM301B3CYG.48.1.A01.1.454.light.4.raw

SEQ ID NO: 551117 - DNA, 481 bp, Homo sapiens
  misc_feature: HIJSMM301C2X8U.52.72.G06.1.454.light.4.raw
cgcagtacgacacgaccggtgctcgatttagctacgactgcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactgtggctgcacc

SEQ ID NO: 551118 - DNA, 508 bp, Homo sapiens
  misc_feature: HIJSMM301BTW1Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatcaaaacgaactagtggctgcaccatctgtcttctatcttccccg

SEQ ID NO: 551119 - DNA, 441 bp, Homo sapiens; identical to SEQ ID NO: 546257
  misc_feature: HIJSMM301EWRA1.41.9.A09.1.454.light.4.raw

SEQ ID NO: 551120 - DNA, 487 bp, Homo sapiens
  misc_feature: HIJSMM301CQDL1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 551121 - DNA, 477 bp, Homo sapiens; identical to SEQ ID NO: 535122
  misc_feature: HIJSMM301EL7HW.26.72.G06.1.454.light.4.raw

SEQ ID NO: 551122 - DNA, 502 bp, Homo sapiens
  misc_feature: HIJSMM301CNGB0.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccgaagggtggaggatacaaacgaactgtggctgcaccatctgtcttcatt

SEQ ID NO: 551123 - DNA, 494 bp, Homo sapiens; identical to SEQ ID NO: 534994
  misc_feature: HIJSMM301AIG71.27.78.H01.1.454.light.4.raw

SEQ ID NO: 551124 - DNA, 504 bp, Homo sapiens; identical to SEQ ID NO: 535077
  misc_feature: HIJSMM301B78P4.8.28.C06.1.454.light.4.raw

SEQ ID NO: 551125 - DNA, 484 bp, Homo sapiens; identical to SEQ ID NO: 535400
  misc_feature: HIJSMM301BVZ6J.46.26.C04.1.454.light.4.raw

SEQ ID NO: 551126 - DNA, 500 bp, Homo sapiens
  misc_feature: HIJSMM301C8BOZ.10.68.G02.1.454.light.4.raw
catagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccaggggtcgatgaggctgactactactgtttctcgactgacttcactggtaaacgttggctgttcggcggagggaccaagctgaccgtcctgcgtcagcccaaggctgccccctcggtcactc

SEQ ID NO: 551127 - DNA, 505 bp, Homo sapiens
  misc_feature: HIJSMM301DIJ7E.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagtattttgctagtttattactgtcagcagcgggcaattggccgctcacttcggcgggggaccgaggtggagttacaacgaactgtggcgtgcaccatctgtcttctactcttcccgt

SEQ ID NO: 551128 - DNA, 499 bp, Homo sapiens
  misc_feature: HIJSMM301CZBUG.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagccaaggctgccccctcgtcga

SEQ ID NO: 551129 - DNA, 505 bp, Homo sapiens
  misc_feature: HIJSMM301CGLP9.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcta

SEQ ID NO: 551130 - DNA, 505 bp, Homo sapiens
  misc_feature: HIJSMM301CBRTV.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtcccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagccaacggccaaccccacctgtcta

SEQ ID NO: 551131 - DNA, 404 bp, Homo sapiens; identical to SEQ ID NO: 535530
  misc_feature: HIJSMM301C053Z.4.35.D02.1.454.light.4.raw

SEQ ID NO: 551132 - DNA, 486 bp, Homo sapiens
  misc_feature: HIJSMM301CKN7A.4.71.G05.1.454.light.4.raw
agcactgtagcacgaccggtgctcgatttagtgtcgtcgcaagagagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacgaa

SEQ ID NO: 551133 - DNA, 488 bp, Homo sapiens
  misc_feature: HIJSMM301BEWV6.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgctagtttattactgtcagcactctaatgactggcccctgtacacttttggcccggggaccaaggtggagatcaaacgaactgtggctgcaccatctgtt

SEQ ID NO: 551134 - DNA, 447 bp, Homo sapiens; identical to SEQ ID NO: 535201
  misc_feature: HIJSMM301DAY5K.18.9.A09.1.454.light.4.raw

SEQ ID NO: 551135 - DNA, 491 bp, Homo sapiens
  misc_feature: HIJSMM301AMR6D.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 551136 - DNA, 504 bp, Homo sapiens; identical to SEQ ID NO: 539091
  misc_feature: HIJSMM301BYXB5.8.28.C06.1.454.light.4.raw

SEQ ID NO: 551137 - DNA, 466 bp, Homo sapiens
  misc_feature: HIJSMM301EBHHJ.51.34.D01.1.454.light.4.raw
cgatcgtatacacgaccggtgctcgatttagatcgtctgtgttgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggacggaacggtaggaggata

SEQ ID NO: 551138 - DNA, 493 bp, Homo sapiens; identical to SEQ ID NO: 540880
  misc_feature: HIJSMM301AXTJO.40.81.H04.1.454.light.4.raw

SEQ ID NO: 551139 - DNA, 503 bp, Homo sapiens; identical to SEQ ID NO: 537216
  misc_feature: HIJSMM301E04QR.3.70.G04.1.454.light.4.raw

SEQ ID NO: 551140 - DNA, 519 bp, Homo sapiens
  misc_feature: HIJSMM301BFEZJ.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcctaccctcctccgt

SEQ ID NO: 551141 - DNA, 467 bp, Homo sapiens
  misc_feature: HIJSMM301BDHD5.41.81.H04.1.454.light.4.raw
tctatactatcacgaccggtgctcgatttagtagtgtagattcgcgggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtgggtcccatcaaggttcagcggcagtggatctggcacagatttcactctcaccatcagcagcctgcagcctgaagattttgcaacttattactgtctacaagattacaattaccctcggacttttggccagggaccaggctggagatcaaacgaa

SEQ ID NO: 551142 - DNA, 520 bp, Homo sapiens; identical to SEQ ID NO: 543998
  misc_feature: HIJSMM301CIGUX.27.23.C01.1.454.light.4.raw

SEQ ID NO: 551143 - DNA, 444 bp, Homo sapiens; identical to SEQ ID NO: 535027
  misc_feature: HIJSMM301EX5C3.8.73.G07.1.454.light.4.raw

SEQ ID NO: 551144 - DNA, 510 bp, Homo sapiens; identical to SEQ ID NO: 538767
  misc_feature: HIJSMM301AT2YZ.17.28.C06.1.454.light.4.raw

SEQ ID NO: 551145 - DNA, 504 bp, Homo sapiens
  misc_feature: HIJSMM301A08DK.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaacgggaccgaacggtaggagtatacagaacgaacctagtggc

SEQ ID NO: 551146 - DNA, 509 bp, Homo sapiens; identical to SEQ ID NO: 543741
  misc_feature: HIJSMM301CTWUY.17.33.C11.1.454.light.4.raw

SEQ ID NO: 551147 - DNA, 486 bp, Homo sapiens; identical to SEQ ID NO: 544134
  misc_feature: HIJSMM301DIDCB.17.26.C04.1.454.light.4.raw

SEQ ID NO: 551148 - DNA, 462 bp, Homo sapiens
  misc_feature: HIJSMM301C8Q8T.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaacgaactgtggctgcaccatctgtcttcatcttcccgccatctgacactactatg

SEQ ID NO: 551149 - DNA, 499 bp, Homo sapiens
  misc_feature: HIJSMM301DBG4U.48.34.D01.1.454.light.4.raw
agtatacatacacgaccggtgctcgatttagatcgtctgtgttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 551150 - DNA, 488 bp, Homo sapiens
  misc_feature: HIJSMM301AQPE8.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtt

SEQ ID NO: 551151 - DNA, 475 bp, Homo sapiens
  misc_feature: HIJSMM301BS0K9.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagacccc

SEQ ID NO: 551152 - DNA, 504 bp, Homo sapiens
  misc_feature: HIJSMM301AMTDW.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcc

SEQ ID NO: 551153 - DNA, 512 bp, Homo sapiens
  misc_feature: HIJSMM301A4F9V.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccccactgtcactctcg

SEQ ID NO: 551154 - DNA, 498 bp, Homo sapiens
  misc_feature: HIJSMM301C08NT.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagattttgcagtttattattgtcagcagtataataactggcctcgtggacgttcggccaaggaccaaggtggaatacaaacgaactgtggctgcaccatctgtcttcta

SEQ ID NO: 551155 - DNA, 488 bp, Homo sapiens
  misc_feature: HIJSMM301AILDM.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcga

SEQ ID NO: 551156 - DNA, 495 bp, Homo sapiens; identical to SEQ ID NO: 538651
  misc_feature: HIJSMM301AODNQ.10.79.H02.1.454.light.4.raw

SEQ ID NO: 551157 - DNA, 486 bp, Homo sapiens
  misc_feature: HIJSMM301AU0NA.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcagcagcctgcagcctgaagatattgcaacatattactgtcaacagtatgataatctcccactcactttcggcggagggaccgaaggtggagatcaaacgaaacgtgtggctgcacca

SEQ ID NO: 551158 - DNA, 496 bp, Homo sapiens; identical to SEQ ID NO: 537925
  misc_feature: HIJSMM301AZ1MU.22.14.B03.1.454.light.4.raw

SEQ ID NO: 551159 - DNA, 533 bp, Homo sapiens
  misc_feature: HIJSMM301D9WQB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgacggaccgaacggtaggaaggtacgaaacgaaactacgtaggtcgtgcgaccactactgtcttcctactcttcccgtcccctactactcgtat

SEQ ID NO: 551160 - DNA, 496 bp, Homo sapiens
  misc_feature: HIJSMM301B8F43.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagccaaggctgccccctc

SEQ ID NO: 551161 - DNA, 500 bp, Homo sapiens
  misc_feature: HIJSMM301DR81S.43.14.B03.1.454.light.4.raw
tgtgagtagtcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaacccc

SEQ ID NO: 551162 - DNA, 487 bp, Homo sapiens; identical to SEQ ID NO: 536206
  misc_feature: HIJSMM301ATFJE.47.38.D05.1.454.light.4.raw

SEQ ID NO: 551163 - DNA, 514 bp, Homo sapiens; identical to SEQ ID NO: 546238
  misc_feature: HIJSMM301BF0CS.47.85.H08.1.454.light.4.raw

SEQ ID NO: 551164 - DNA, 500 bp, Homo sapiens
  misc_feature: HIJSMM301EMR10.48.55.E11.1.454.light.4.raw
agtatacatacacgaccggtgctcgatttagcactcgcacgttgggtttaggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtca

SEQ ID NO: 551165 - DNA, 491 bp, Homo sapiens
  misc_feature: HIJSMM301EE11F.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaacgtaggacgatcaagcgaactgtggctgcaccatct

SEQ ID NO: 551166 - DNA, 492 bp, Homo sapiens
  misc_feature: HIJSMM301CNEDU.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccccactgtcactctgttcccaccctcctctacgtgagct

SEQ ID NO: 551167 - DNA, 493 bp, Homo sapiens; identical to SEQ ID NO: 539202
  misc_feature: HIJSMM301AY30I.22.57.F02.1.454.light.4.raw

SEQ ID NO: 551168 - DNA, 447 bp, Homo sapiens; identical to SEQ ID NO: 535201
  misc_feature: HIJSMM301AG9HA.18.9.A09.1.454.light.4.raw

SEQ ID NO: 551169 - DNA, 500 bp, Homo sapiens
  misc_feature: HIJSMM301B92EG.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagttttattactgtcaccagtatcataactggcctccaaggggacttcgccaggaccaggtggattcaaccgaactgtggctgcaccatctgtcttcatcttcccg

SEQ ID NO: 551170 - DNA, 465 bp, Homo sapiens
  misc_feature: HIJSMM301CQL5D.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacagggtcccatcaaggttcagtggaagtggatctgggacagattttactttcaccatcagcagcctgcagcctgaagatattgcaacatattactgtcagcagtatgataatctcccgatcacattcggccaagggacacgactggagattaaacgaa

SEQ ID NO: 551171 - DNA, 493 bp, Homo sapiens; identical to SEQ ID NO: 540127
  misc_feature: HIJSMM301CI1BT.10.17.B06.1.454.light.4.raw

SEQ ID NO: 551172 - DNA, 485 bp, Homo sapiens
  misc_feature: HIJSMM301DOSDV.52.55.E11.1.454.light.4.raw
cgcagtacgacacgaccggtgctcgatttagcactcgcacgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 551173 - DNA, 496 bp, Homo sapiens; identical to SEQ ID NO: 537925
  misc_feature: HIJSMM301DDWWE.22.14.B03.1.454.light.4.raw

SEQ ID NO: 551174 - DNA, 460 bp, Homo sapiens; identical to SEQ ID NO: 536053
  misc_feature: HIJSMM301B67LD.22.28.C06.1.454.light.4.raw

SEQ ID NO: 551175 - DNA, 486 bp, Homo sapiens
  misc_feature: HIJSMM301B78BB.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcacc

SEQ ID NO: 551176 - DNA, 508 bp, Homo sapiens
  misc_feature: HIJSMM301BFI8M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaagggaccaaggtaggaaagtcaaaacgaactagtggctgcaccaactctgtcttcctatcttccccg

SEQ ID NO: 551177 - DNA, 506 bp, Homo sapiens
  misc_feature: HIJSMM301DLAMY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtaggaaatcaaacgaactagtggctgcaccatctgtcttcatcttccccg

SEQ ID NO: 551178 - DNA, 522 bp, Homo sapiens
  misc_feature: HIJSMM301EMNBD.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtcgt

SEQ ID NO: 551179 - DNA, 480 bp, Homo sapiens
  misc_feature: HIJSMM301B454D.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccaagctgaccgtcctaggtcacg

SEQ ID NO: 551180 - DNA, 474 bp, Homo sapiens
  misc_feature: HIJSMM301CA8RB.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtaggatatcaaacgaactagtggctgcaccatctgtcttcatcttcccgccat

SEQ ID NO: 551181 - DNA, 506 bp, Homo sapiens
  misc_feature: HIJSMM301BRJPC.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccgactttcggccctgggaccaaagtggatatacaacgaactgtggctgcaccatctgtctt

SEQ ID NO: 551182 - DNA, 491 bp, Homo sapiens
  misc_feature: HIJSMM301A0TOL.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaaacgaactgtgg

SEQ ID NO: 551183 - DNA, 497 bp, Homo sapiens; identical to SEQ ID NO: 538296
  misc_feature: HIJSMM301BC8I7.18.11.A11.1.454.light.4.raw

SEQ ID NO: 551184 - DNA, 498 bp, Homo sapiens
  misc_feature: HIJSMM301AHSDM.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggagggaccgagctgaccgtcctacgtcagcccaaggctcg

SEQ ID NO: 551185 - DNA, 516 bp, Homo sapiens
  misc_feature: HIJSMM301CRFPP.47.53.E09.1.454.light.4.raw
agctcacgtacacgaccggtgctcgatttagagagagtgtgttgggtttggggctgggcctaaggaagcagcactggtggtgcctcagtcatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccgccctcct

SEQ ID NO: 551186 - DNA, 515 bp, Homo sapiens
  misc_feature: HIJSMM301D6LLV.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgttcccacctctccacg

SEQ ID NO: 551187 - DNA, 489 bp, Homo sapiens
  misc_feature: HIJSMM301DGEHT.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatcccagatgacccagtcgtccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatctgt

SEQ ID NO: 551188 - DNA, 489 bp, Homo sapiens; identical to SEQ ID NO: 535139
  misc_feature: HIJSMM301CH9Q9.14.55.E11.1.454.light.4.raw

SEQ ID NO: 551189 - DNA, 489 bp, Homo sapiens
  misc_feature: HIJSMM301EMS0W.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgacccattactggactccagcctgaggacgaggctgactattactgctcagcatgggacagcggcctcaggacttatgtcttcggaactgggacccacgttaccgtcctaggtcagaccccg

SEQ ID NO: 551190 - DNA, 483 bp, Homo sapiens
  misc_feature: HIJSMM301BXUVK.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccaaggtggaaatacaaacgaactagtggctgcacca

SEQ ID NO: 551191 - DNA, 472 bp, Homo sapiens
  misc_feature: HIJSMM301DNNM5.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaaatcactttcggccctgggactgaagtgcatatgaagagaactgtgg

SEQ ID NO: 551192 - DNA, 454 bp, Homo sapiens; identical to SEQ ID NO: 535005
  misc_feature: HIJSMM301AOQ53.19.86.H09.1.454.light.4.raw

SEQ ID NO: 551193 - DNA, 434 bp, Homo sapiens; identical to SEQ ID NO: 535153
  misc_feature: HIJSMM301BX6U8.18.5.A05.1.454.light.4.raw

SEQ ID NO: 551194 - DNA, 476 bp, Homo sapiens; identical to SEQ ID NO: 538611
  misc_feature: HIJSMM301C02RQ.7.81.H04.1.454.light.4.raw

SEQ ID NO: 551195 - DNA, 480 bp, Homo sapiens; identical to SEQ ID NO: 535291
  misc_feature: HIJSMM301EG1JT.22.59.F04.1.454.light.4.raw

SEQ ID NO: 551196 - DNA, 479 bp, Homo sapiens; identical to SEQ ID NO: 537615
  misc_feature: HIJSMM301AOXN5.21.25.C03.1.454.light.4.raw

SEQ ID NO: 551197 - DNA, 490 bp, Homo sapiens; identical to SEQ ID NO: 535234
  misc_feature: HIJSMM301A0G7O.17.21.B10.1.454.light.4.raw

SEQ ID NO: 551198 - DNA, 511 bp, Homo sapiens
  misc_feature: HIJSMM301BIZXJ.17.2.A02.1.454.light.4.raw
cgtagactagcacgaccggtgctcgatttagactcatctacaggggggtaggagaagacaggactcaggacaatctccagcatggccagcttccctctcctcctcaccctcctcactcactgtgcagggtcctgggcccgagtctgtactgactcagccaccctcagcgtctgggaccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgccct

SEQ ID NO: 551199 - DNA, 511 bp, Homo sapiens
  misc_feature: HIJSMM301B1T5O.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccc

SEQ ID NO: 551200 - DNA, 473 bp, Homo sapiens
  misc_feature: HIJSMM301BM9FT.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaaa

SEQ ID NO: 551201 - DNA, 487 bp, Homo sapiens; identical to SEQ ID NO: 539157
  misc_feature: HIJSMM301DQG80.26.37.D04.1.454.light.4.raw

SEQ ID NO: 551202 - DNA, 482 bp, Homo sapiens; identical to SEQ ID NO: 537205
  misc_feature: HIJSMM301A25GE.5.39.D06.1.454.light.4.raw

SEQ ID NO: 551203 - DNA, 441 bp, Homo sapiens; identical to SEQ ID NO: 535074
  misc_feature: HIJSMM301AYQJ9.11.3.A03.1.454.light.4.raw

SEQ ID NO: 551204 - DNA, 506 bp, Homo sapiens
  misc_feature: HIJSMM301DVKBJ.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 551205 - DNA, 478 bp, Homo sapiens; identical to SEQ ID NO: 535129
  misc_feature: HIJSMM301CRBFO.11.11.A11.1.454.light.4.raw

SEQ ID NO: 551206 - DNA, 447 bp, Homo sapiens; identical to SEQ ID NO: 535201
  misc_feature: HIJSMM301BA8LE.18.9.A09.1.454.light.4.raw

SEQ ID NO: 551207 - DNA, 487 bp, Homo sapiens; identical to SEQ ID NO: 536206
  misc_feature: HIJSMM301EZI51.47.38.D05.1.454.light.4.raw

SEQ ID NO: 551208 - DNA, 473 bp, Homo sapiens; identical to SEQ ID NO: 535262
  misc_feature: HIJSMM301B4LVA.8.67.G01.1.454.light.4.raw

SEQ ID NO: 551209 - DNA, 480 bp, Homo sapiens
  misc_feature: HIJSMM301EPNTQ.51.72.G06.1.454.light.4.raw
cgatcgtatacacgaccggtgctcgatttagctacgactgcaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttaatcctcggacgttcgccaaggaccaaggtaggaaatcaaacgaactagtggctgcaccat

SEQ ID NO: 551210 - DNA, 484 bp, Homo sapiens; identical to SEQ ID NO: 538247
  misc_feature: HIJSMM301D99UE.14.53.E09.1.454.light.4.raw

SEQ ID NO: 551211 - DNA, 488 bp, Homo sapiens; identical to SEQ ID NO: 535081
  misc_feature: HIJSMM301DH3ZC.26.23.C01.1.454.light.4.raw

SEQ ID NO: 551212 - DNA, 484 bp, Homo sapiens
  misc_feature: HIJSMM301BYSL6.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtcctaggtcagcccaaggccaa

SEQ ID NO: 551213 - DNA, 494 bp, Homo sapiens; identical to SEQ ID NO: 534994
  misc_feature: HIJSMM301AGV2O.27.78.H01.1.454.light.4.raw

SEQ ID NO: 551214 - DNA, 486 bp, Homo sapiens
  misc_feature: HIJSMM301B49AR.10.53.E09.1.454.light.4.raw
catagtagtgcacgaccggtgctcgatttagagagagtgtgttgggtttgggggagctacaacaggcaggcaagggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaa

SEQ ID NO: 551215 - DNA, 479 bp, Homo sapiens; identical to SEQ ID NO: 535118
  misc_feature: HIJSMM301DHT4H.13.59.F04.1.454.light.4.raw

SEQ ID NO: 551216 - DNA, 477 bp, Homo sapiens; identical to SEQ ID NO: 545166
  misc_feature: HIJSMM301ARSNH.5.28.C06.1.454.light.4.raw

SEQ ID NO: 551217 - DNA, 514 bp, Homo sapiens; identical to SEQ ID NO: 544770
  misc_feature: HIJSMM301DWXVD.16.66.F11.1.454.light.4.raw

SEQ ID NO: 551218 - DNA, 494 bp, Homo sapiens
  misc_feature: HIJSMM301DYABU.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaaggaccgaaggtaggaatacaaacgaactagtggctgcaccactctgtt

SEQ ID NO: 551219 - DNA, 501 bp, Homo sapiens; identical to SEQ ID NO: 535873
  misc_feature: HIJSMM301CWXZN.17.27.C05.1.454.light.4.raw

SEQ ID NO: 551220 - DNA, 479 bp, Homo sapiens
  misc_feature: HIJSMM301B58BB.52.1.A01.1.454.light.4.raw
cgcagtacgacacgaccggtgctcgatttagacgtctcatcaggggagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtcttcta

SEQ ID NO: 551221 - DNA, 498 bp, Homo sapiens; identical to SEQ ID NO: 536173
  misc_feature: HIJSMM301AYGY9.12.86.H09.1.454.light.4.raw

SEQ ID NO: 551222 - DNA, 490 bp, Homo sapiens; identical to SEQ ID NO: 541974
  misc_feature: HIJSMM301DXM4Q.22.65.F10.1.454.light.4.raw

SEQ ID NO: 551223 - DNA, 495 bp, Homo sapiens; identical to SEQ ID NO: 543631
  misc_feature: HIJSMM301DVO8T.11.59.F04.1.454.light.4.raw

SEQ ID NO: 551224 - DNA, 473 bp, Homo sapiens; identical to SEQ ID NO: 538793
  misc_feature: HIJSMM301BU02E.5.34.D01.1.454.light.4.raw

SEQ ID NO: 551225 - DNA, 495 bp, Homo sapiens; identical to SEQ ID NO: 538651
  misc_feature: HIJSMM301A69GS.10.79.H02.1.454.light.4.raw

SEQ ID NO: 551226 - DNA, 513 bp, Homo sapiens; identical to SEQ ID NO: 535244
  misc_feature: HIJSMM301AVVB2.17.33.C11.1.454.light.4.raw

SEQ ID NO: 551227 - DNA, 489 bp, Homo sapiens
  misc_feature: HIJSMM301CNE1R.43.73.G07.1.454.light.4.raw
  modified_base (471)..(471): a, c, t, g, unknown or other
tgtgagtagtcacgaccggtgctcgatttagctctacgctcagggcacgaccggtgctcgatttagagagagtgtgttgggtttgggggcttgtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcactctgttcccnccctcctcactactcaca

SEQ ID NO: 551228 - DNA, 496 bp, Homo sapiens; identical to SEQ ID NO: 536248
  misc_feature: HIJSMM301C3M2L.22.27.C05.1.454.light.4.raw

SEQ ID NO: 551229 - DNA, 504 bp, Homo sapiens; identical to SEQ ID NO: 535561
  misc_feature: HIJSMM301AMAKA.4.57.F02.1.454.light.4.raw

SEQ ID NO: 551230 - DNA, 499 bp, Homo sapiens
  misc_feature: HIJSMM301C9UNO.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaaagcagcagcactctcgtggtattcggcggagggaccaagctgaccgtcctaggtcagcccaaggctcg

SEQ ID NO: 551231 - DNA, 463 bp, Homo sapiens; identical to SEQ ID NO: 535062
  misc_feature: HIJSMM301BAAPK.11.73.G07.1.454.light.4.raw

SEQ ID NO: 551232 - DNA, 493 bp, Homo sapiens
  misc_feature: HIJSMM301DT3K2.13.5.A05.1.454.light.4.raw
  modified_base (452)..(452): a, c, t, g, unknown or other
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtnttaggtcagcccaaggctgccccctcggtcactctgttccc

SEQ ID NO: 551233 - DNA, 488 bp, Homo sapiens; identical to SEQ ID NO: 535861
  misc_feature: HIJSMM301DJB80.14.55.E11.1.454.light.4.raw

SEQ ID NO: 551234 - DNA, 493 bp, Homo sapiens; identical to SEQ ID NO: 538304
  misc_feature: HIJSMM301B4UCY.26.72.G06.1.454.light.4.raw

SEQ ID NO: 551235 - DNA, 490 bp, Homo sapiens; identical to SEQ ID NO: 535936
  misc_feature: HIJSMM301EFQGW.16.68.G02.1.454.light.4.raw

SEQ ID NO: 551236 - DNA, 502 bp, Homo sapiens; identical to SEQ ID NO: 541971
  misc_feature: HIJSMM301B91HR.4.39.D06.1.454.light.4.raw

SEQ ID NO: 551237 - DNA, 493 bp, Homo sapiens
  misc_feature: HIJSMM301B9ONC.43.25.C03.1.454.light.4.raw
tgtgagtagtcacgaccggtgctcgatttagtagtgtagatttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggccccgtcaccttcggccaagggacacgactggagattaaacgaactgtgg

SEQ ID NO: 551238 - DNA, 501 bp, Homo sapiens
  misc_feature: HIJSMM301D1F49.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggcctgggaccaaagtggatatcaaacgaactagtggctgcaccatctgtcttcatt

SEQ ID NO: 551239 - DNA, 508 bp, Homo sapiens
  misc_feature: HIJSMM301CDHC6.15.1.A01.1.454.light.4.raw
  modified_base (475)..(475): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcctccgccctccncgtactacgtacgacgtgacggcggtcgtggac

SEQ ID NO: 551240 - DNA, 506 bp, Homo sapiens; identical to SEQ ID NO: 534969
  misc_feature: HIJSMM301BDMZE.18.37.D04.1.454.light.4.raw

SEQ ID NO: 551241 - DNA, 503 bp, Homo sapiens; identical to SEQ ID NO: 538884
  misc_feature: HIJSMM301C605D.27.78.H01.1.454.light.4.raw

SEQ ID NO: 551242 - DNA, 494 bp, Homo sapiens; identical to SEQ ID NO: 534992
  misc_feature: HIJSMM301EEVFM.9.1.A01.1.454.light.4.raw

SEQ ID NO: 551243 - DNA, 501 bp, Homo sapiens
  misc_feature: HIJSMM301DAG6W.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagtccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtagaaattaaacgaactgtggctgcaccatctgtcttcatcttcccg

SEQ ID NO: 551244 - DNA, 463 bp, Homo sapiens; identical to SEQ ID NO: 535062
  misc_feature: HIJSMM301A4I3C.11.73.G07.1.454.light.4.raw

SEQ ID NO: 551245 - DNA, 480 bp, Homo sapiens
  misc_feature: HIJSMM301BCSTZ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcgggacc

SEQ ID NO: 551246 - DNA, 502 bp, Homo sapiens; identical to SEQ ID NO: 536604
  misc_feature: HIJSMM301A7UX8.27.78.H01.1.454.light.4.raw

SEQ ID NO: 551247 - DNA, 494 bp, Homo sapiens; identical to SEQ ID NO: 537501
  misc_feature: HIJSMM301EJGGH.10.79.H02.1.454.light.4.raw

SEQ ID NO: 551248 - DNA, 487 bp, Homo sapiens
  misc_feature: HIJSMM301A0LUE.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggcttcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 551249 - DNA, 506 bp, Homo sapiens
  misc_feature: HIJSMM301EZ1CI.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcact

SEQ ID NO: 551250 - DNA, 444 bp, Homo sapiens; identical to SEQ ID NO: 535027
  misc_feature: HIJSMM301BM4E1.8.73.G07.1.454.light.4.raw

SEQ ID NO: 551251 - DNA, 495 bp, Homo sapiens; identical to SEQ ID NO: 542416
  misc_feature: HIJSMM301DY4DT.27.78.H01.1.454.light.4.raw

SEQ ID NO: 551252 - DNA, 484 bp, Homo sapiens; identical to SEQ ID NO: 535211
  misc_feature: HIJSMM301DBEDI.47.46.E02.1.454.light.4.raw

SEQ ID NO: 551253 - DNA, 496 bp, Homo sapiens
  misc_feature: HIJSMM301EGZ56.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcaccttgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctggcaccatctgtctt

SEQ ID NO: 551254 - DNA, 485 bp, Homo sapiens; identical to SEQ ID NO: 550642
  misc_feature: HIJSMM301BU68E.41.39.D06.1.454.light.4.raw

SEQ ID NO: 551255 - DNA, 496 bp, Homo sapiens
  misc_feature: HIJSMM301C0EIY.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggaccgaaggtggagttcaaacgaactgtggctgcaccatctgtcttcatt

SEQ ID NO: 551256 - DNA, 492 bp, Homo sapiens; identical to SEQ ID NO: 535426
  misc_feature: HIJSMM301DTDXH.47.78.H01.1.454.light.4.raw

SEQ ID NO: 551257 - DNA, 447 bp, Homo sapiens; identical to SEQ ID NO: 535201
  misc_feature: HIJSMM301EGBVF.18.9.A09.1.454.light.4.raw

SEQ ID NO: 551258 - DNA, 454 bp, Homo sapiens; identical to SEQ ID NO: 536347
  misc_feature: HIJSMM301AZGG8.19.86.H09.1.454.light.4.raw

SEQ ID NO: 551259 - DNA, 496 bp, Homo sapiens; identical to SEQ ID NO: 535109
  misc_feature: HIJSMM301EZOXP.16.78.H01.1.454.light.4.raw

SEQ ID NO: 551260 - DNA, 454 bp, Homo sapiens; identical to SEQ ID NO: 536449
  misc_feature: HIJSMM301BECR0.18.78.H01.1.454.light.4.raw

SEQ ID NO: 551261 - DNA, 494 bp, Homo sapiens; identical to SEQ ID NO: 539865
  misc_feature: HIJSMM301AQ9BU.9.1.A01.1.454.light.4.raw

SEQ ID NO: 551262 - DNA, 494 bp, Homo sapiens; identical to SEQ ID NO: 534992
  misc_feature: HIJSMM301B6H8C.9.1.A01.1.454.light.4.raw

SEQ ID NO: 551263 - DNA, 471 bp, Homo sapiens
  misc_feature: HIJSMM301BOC4B.48.73.G07.1.454.light.4.raw
agtatacatacacgaccggtgctcgatttagctctacgctcagggcacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattctgcaacagtatcatactattctcggacctcggtcc

SEQ ID NO: 551264 - DNA, 483 bp, Homo sapiens
  misc_feature: HIJSMM301DKGL8.40.83.H06.1.454.light.4.raw
  modified_base (446)..(446): a, c, t, g, unknown or other
tctagcgactcacgaccggtgctcgatttagatcacgtgcgtcgcgggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacgcagcctcagtgaatgggtnttcggcggagggaccaaactgtccgtcctaggtcacg

SEQ ID NO: 551265 - DNA, 475 bp, Homo sapiens
  misc_feature: HIJSMM301DHH2T.12.49.E05.1.454.light.4.raw
  modified_base (466)..(466): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtacaaaagtataacagtcgcccccttcaccttcggccaagggacacgactgganattagaacg

SEQ ID NO: 551266 - DNA, 495 bp, Homo sapiens
  misc_feature: HIJSMM301BEAC5.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccgtcggacaaacgtaggagttctaaacgaaactagtggcgtgcaccaact

SEQ ID NO: 551267 - DNA, 499 bp, Homo sapiens
  misc_feature: HIJSMM301DF5M5.48.34.D01.1.454.light.4.raw
agtatacatacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctccg

SEQ ID NO: 551268 - DNA, 485 bp, Homo sapiens
  misc_feature: HIJSMM301EJUMM.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaaggggcacgactggagattaaacgaactgtggctgcaccat

SEQ ID NO: 551269 - DNA, 516 bp, Homo sapiens
  misc_feature: HIJSMM301AFXTA.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccaccctcct

SEQ ID NO: 551270 - DNA, 461 bp, Homo sapiens
  misc_feature: HIJSMM301C5PWT.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccacctcttgttctggaagcgactccaacatcggcgatactcatgtgtactggtaccaacaggtcccagggacggccccaaacctcctcatgtatgacagtagtgagcggccctcaggggtcccgtgaccgattctctggctctaagtctggcacctcggcctccctggacatcagtggcctccggtccgaggatgaggctgattattactgtgcagcatgggattacaacctgagtgatcctagttgggtgttcggcggagggaccaggccgaccgtcctaggtcagcccaaggctgccccctcggtcactctgttcccaccctcctcacgcgtatgt

SEQ ID NO: 551271 - DNA, 445 bp, Homo sapiens
  misc_feature: HIJSMM301B28UA.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgccccctcggtcactctgttcccaccctcctccgtgtctgat

SEQ ID NO: 551272 - DNA, 487 bp, Homo sapiens
  misc_feature: HIJSMM301C0V2C.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgcccccc

SEQ ID NO: 551273 - DNA, 504 bp, Homo sapiens; identical to SEQ ID NO: 549053
  misc_feature: HIJSMM301DLICQ.4.71.G05.1.454.light.4.raw

SEQ ID NO: 551274 - DNA, 490 bp, Homo sapiens
  misc_feature: HIJSMM301DQNBV.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcgcgttttcggcgggggtaccgaggtggacatcaaacgaactgtggctgcaccatctcgt

SEQ ID NO: 551275 - DNA, 492 bp, Homo sapiens
  misc_feature: HIJSMM301AG08J.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggtccaggggaccgaggctggagatacaaacgaactagtgg

SEQ ID NO: 551276 - DNA, 455 bp, Homo sapiens
  misc_feature: HIJSMM301AP7Z0.19.86.H09.1.454.light.4.raw
tactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 551277 - DNA, 384 bp, Homo sapiens
  misc_feature: HIJSMM301DIEU2.12.41.D08.1.454.light.4.raw
atacgacgtacacgaccggtgctcgatttagtcacgcgagaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgcactttattactgtcagcactataataattggcctccggagtacacctttggccaggggaccaagctggagatcaaacgaactgtggctgcaccatctgtcttcatcttccgccatctgatacgtcgtat

SEQ ID NO: 551278 - DNA, 468 bp, Homo sapiens
  misc_feature: HIJSMM301DPQIT.48.39.D06.1.454.light.4.raw
agtatacatacacgaccggtgctcgatttagtgacatctcgcagttctttgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 551279 - DNA, 489 bp, Homo sapiens
  misc_feature: HIJSMM301D60D4.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccgaagctggagatcaggcgaacg

SEQ ID NO: 551280 - DNA, 504 bp, Homo sapiens; identical to SEQ ID NO: 539083
  misc_feature: HIJSMM301DD84W.8.19.B08.1.454.light.4.raw

SEQ ID NO: 551281 - DNA, 422 bp, Homo sapiens; identical to SEQ ID NO: 537797
  misc_feature: HIJSMM301AGN7U.9.34.D01.1.454.light.4.raw

SEQ ID NO: 551282 - DNA, 445 bp, Homo sapiens
  misc_feature: HIJSMM301AKMS2.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcgggcggcgggaccaagttgaccgtcctacgtcagcccaaggctgccccctcggtcactctgttcccaccctcctcgacacgcgag

SEQ ID NO: 551283 - DNA, 495 bp, Homo sapiens; identical to SEQ ID NO: 536827
  misc_feature: HIJSMM301EVYS3.48.63.F08.1.454.light.4.raw

SEQ ID NO: 551284 - DNA, 504 bp, Homo sapiens
  misc_feature: HIJSMM301B44YW.9.71.G05.1.454.light.4.raw
tgatacgtctcacgaccggtgctcgatttagtgtcgtcgcaagagagaggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccccg

SEQ ID NO: 551285 - DNA, 487 bp, Homo sapiens
  misc_feature: HIJSMM301DBZAM.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggcccaaccca

SEQ ID NO: 551286 - DNA, 484 bp, Homo sapiens
  misc_feature: HIJSMM301B73LY.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtacctgctcactttcggcggagggaccaaggtggagatacaaacgaactgtggctgcaccta

SEQ ID NO: 551287 - DNA, 496 bp, Homo sapiens; identical to SEQ ID NO: 536248
  misc_feature: HIJSMM301D0I7G.22.27.C05.1.454.light.4.raw

SEQ ID NO: 551288 - DNA, 489 bp, Homo sapiens
  misc_feature: HIJSMM301DJ026.5.23.C01.1.454.light.4.raw
atcagacacgcacgaccggtgctcgatttagtacacgtgattagggattggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactagtggctgcaccat

SEQ ID NO: 551289 - DNA, 497 bp, Homo sapiens
  misc_feature: HIJSMM301CX0XM.10.79.H02.1.454.light.4.raw
catagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcggcaatatggtaggtcacctgggacttttggccaggggaccaagctggagatcaaacgaactgtggctgcaccatctgtcttcta

SEQ ID NO: 551290 - DNA, 497 bp, Homo sapiens; identical to SEQ ID NO: 545786
  misc_feature: HIJSMM301CYGGQ.48.59.F04.1.454.light.4.raw

SEQ ID NO: 551291 - DNA, 478 bp, Homo sapiens; identical to SEQ ID NO: 541928
  misc_feature: HIJSMM301EF9CL.7.76.G10.1.454.light.4.raw

SEQ ID NO: 551292 - DNA, 484 bp, Homo sapiens; identical to SEQ ID NO: 535400
  misc_feature: HIJSMM301CTTXZ.46.26.C04.1.454.light.4.raw

SEQ ID NO: 551293 - DNA, 494 bp, Homo sapiens; identical to SEQ ID NO: 534994
  misc_feature: HIJSMM301AJ1UA.27.78.H01.1.454.light.4.raw

SEQ ID NO: 551294 - DNA, 501 bp, Homo sapiens
  misc_feature: HIJSMM301CM471.43.86.H09.1.454.light.4.raw
tgtgagtagtcacgaccggtgctcgatttagtgctatagacttgggtttggggtgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagtctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctcgttcacttttggccaggggaccaaggtggagatcaaacgaactgtggctgcaccat

SEQ ID NO: 551295 - DNA, 505 bp, Homo sapiens; identical to SEQ ID NO: 536254
  misc_feature: HIJSMM301B3PUT.7.71.G05.1.454.light.4.raw

SEQ ID NO: 551296 - DNA, 502 bp, Homo sapiens
  misc_feature: HIJSMM301EZVRE.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctcgaccgattcaatggcagcgggtcgtggggcgagatttcactctcaccatcagcagcctgcaggctgaagatgtggcagtttattactgtcagcaatattatactcctcttccgacgttcggcaaggaccaaggtaggaatacaaacgaactgtggctgcaccat

SEQ ID NO: 551297 - DNA, 488 bp, Homo sapiens
  misc_feature: HIJSMM301EXNOE.40.85.H08.1.454.light.4.raw
tctagcgactcacgaccggtgctcgatttagtatcactcagtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 551298 - DNA, 507 bp, Homo sapiens; identical to SEQ ID NO: 536226
  misc_feature: HIJSMM301EYYGO.18.37.D04.1.454.light.4.raw

SEQ ID NO: 551299 - DNA, 473 bp, Homo sapiens; identical to SEQ ID NO: 541472
  misc_feature: HIJSMM301CURFJ.5.12.B01.1.454.light.4.raw

SEQ ID NO: 551300 - DNA, 514 bp, Homo sapiens
  misc_feature: HIJSMM301EJCVA.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtgggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcct

SEQ ID NO: 551301 - DNA, 497 bp, Homo sapiens
  misc_feature: HIJSMM301D2QXM.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctc

SEQ ID NO: 551302 - DNA, 509 bp, Homo sapiens
  misc_feature: HIJSMM301BDH8X.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccacccttccc

SEQ ID NO: 551303 - DNA, 493 bp, Homo sapiens; identical to SEQ ID NO: 535084
  misc_feature: HIJSMM301D7UZZ.47.64.F09.1.454.light.4.raw

SEQ ID NO: 551304 - DNA, 510 bp, Homo sapiens
  misc_feature: HIJSMM301DJHTY.49.87.H10.1.454.light.4.raw
  modified_base (234)..(234): a, c, t, g, unknown or other
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacngtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggtcggcgggaccaggctgaccgtcctgggtcagcccaaggctgccccctcggtcactctgttcccgt

SEQ ID NO: 551305 - DNA, 457 bp, Homo sapiens
  misc_feature: HIJSMM301EDKQL.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcgatctataatgacgctgagcggtccttaagggtccctgaccgattctctggcgagaggtctaggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccaccgagagta

SEQ ID NO: 551306 - DNA, 478 bp, Homo sapiens
  misc_feature: HIJSMM301DFCRD.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactagtggctgcaccatctgtcttcatcttcccgcca

SEQ ID NO: 551307 - DNA, 444 bp, Homo sapiens; identical to SEQ ID NO: 535027
  misc_feature: HIJSMM301EBMHC.8.73.G07.1.454.light.4.raw

SEQ ID NO: 551308 - DNA, 491 bp, Homo sapiens; identical to SEQ ID NO: 535176
  misc_feature: HIJSMM301BKGVQ.13.39.D06.1.454.light.4.raw

SEQ ID NO: 551309 - DNA, 486 bp, Homo sapiens; identical to SEQ ID NO: 535043
  misc_feature: HIJSMM301AZFBE.46.35.D02.1.454.light.4.raw

SEQ ID NO: 551310 - DNA, 499 bp, Homo sapiens; identical to SEQ ID NO: 535899
  misc_feature: HIJSMM301CR2B5.19.78.H01.1.454.light.4.raw

SEQ ID NO: 551311 - DNA, 524 bp, Homo sapiens
  misc_feature: HIJSMM301AIXWN.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacg

SEQ ID NO: 551312 - DNA, 487 bp, Homo sapiens
  misc_feature: HIJSMM301DQKUD.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtccacgggaccgacggtggagtgtctaagacgaactgtggcgtgcaccact

SEQ ID NO: 551313 - DNA, 507 bp, Homo sapiens
  misc_feature: HIJSMM301AKVF3.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagccccaaggcccaacccccactcgtcactctgttcccgccctcctcta

SEQ ID NO: 551314 - DNA, 504 bp, Homo sapiens; identical to SEQ ID NO: 535495
  misc_feature: HIJSMM301C8COL.14.86.H09.1.454.light.4.raw

SEQ ID NO: 551315 - DNA, 496 bp, Homo sapiens; identical to SEQ ID NO: 535109
  misc_feature: HIJSMM301EJMGP.16.78.H01.1.454.light.4.raw

SEQ ID NO: 551316 - DNA, 496 bp, Homo sapiens; identical to SEQ ID NO: 535109
  misc_feature: HIJSMM301AFUT3.16.78.H01.1.454.light.4.raw

SEQ ID NO: 551317 - DNA, 503 bp, Homo sapiens; identical to SEQ ID NO: 536834
  misc_feature: HIJSMM301EP84I.2.35.D02.1.454.light.4.raw

SEQ ID NO: 551318 - DNA, 489 bp, Homo sapiens
  misc_feature: HIJSMM301B38FZ.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggccggagggaccaaggtggaggatacaaacgaaactgtggctgcacca

SEQ ID NO: 551319 - DNA, 478 bp, Homo sapiens; identical to SEQ ID NO: 543744
  misc_feature: HIJSMM301COZ1N.26.72.G06.1.454.light.4.raw

SEQ ID NO: 551320 - DNA, 505 bp, Homo sapiens
  misc_feature: HIJSMM301DKZUA.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtca

SEQ ID NO: 551321 - DNA, 484 bp, Homo sapiens
  misc_feature: HIJSMM301CFFEO.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgact

SEQ ID NO: 551322 - DNA, 495 bp, Homo sapiens; identical to SEQ ID NO: 537780
  misc_feature: HIJSMM301BF0GS.5.24.C02.1.454.light.4.raw

SEQ ID NO: 551323 - DNA, 454 bp, Homo sapiens
  misc_feature: HIJSMM301DF3AZ.51.38.D05.1.454.light.4.raw
cgatcgtatacacgaccggtgctcgatttagtatctgatagttgggtttgggggctttgcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 551324 - DNA, 486 bp, Homo sapiens; identical to SEQ ID NO: 535043
  misc_feature: HIJSMM301AQNLH.46.35.D02.1.454.light.4.raw

SEQ ID NO: 551325 - DNA, 463 bp, Homo sapiens; identical to SEQ ID NO: 535008
  misc_feature: HIJSMM301CTZYD.10.9.A09.1.454.light.4.raw

SEQ ID NO: 551326 - DNA, 482 bp, Homo sapiens
  misc_feature: HIJSMM301BLZKZ.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggcctggactaaggtggagatcagacgaactgtggctgcacatctgtcttcta

SEQ ID NO: 551327 - DNA, 509 bp, Homo sapiens; identical to SEQ ID NO: 539359
  misc_feature: HIJSMM301BWYUA.47.85.H08.1.454.light.4.raw

SEQ ID NO: 551328 - DNA, 489 bp, Homo sapiens; identical to SEQ ID NO: 541933
  misc_feature: HIJSMM301C6R2L.13.46.E02.1.454.light.4.raw

SEQ ID NO: 551329 - DNA, 504 bp, Homo sapiens
  misc_feature: HIJSMM301C1ZSH.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaagcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtca

SEQ ID NO: 551330 - DNA, 445 bp, Homo sapiens; identical to SEQ ID NO: 542143
  misc_feature: HIJSMM301EJZM1.47.85.H08.1.454.light.4.raw

SEQ ID NO: 551331 - DNA, 508 bp, Homo sapiens
  misc_feature: HIJSMM301BMK1M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaatacaaacgaactagtggctgcaccatctgtcttcatcttccccg

SEQ ID NO: 551332 - DNA, 485 bp, Homo sapiens; identical to SEQ ID NO: 535606
  misc_feature: HIJSMM301C0HW6.47.46.E02.1.454.light.4.raw

SEQ ID NO: 551333 - DNA, 460 bp, Homo sapiens
  misc_feature: HIJSMM301EB4V1.48.9.A09.1.454.light.4.raw
agtatacatacacgaccggtgctcgatttagcgagacgcgcagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 551334 - DNA, 494 bp, Homo sapiens
  misc_feature: HIJSMM301ARFUH.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactgtggctgcaccatctgtt

SEQ ID NO: 551335 - DNA, 493 bp, Homo sapiens
  misc_feature: HIJSMM301AGJ0Y.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaacctaggtgg

SEQ ID NO: 551336 - DNA, 492 bp, Homo sapiens
  misc_feature: HIJSMM301DXA1J.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgcc

SEQ ID NO: 551337 - DNA, 486 bp, Homo sapiens
  misc_feature: HIJSMM301EE8L2.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatactttcgtggacgttcggccaagggaccaaggtggatatcagacgaa

SEQ ID NO: 551338 - DNA, 511 bp, Homo sapiens; identical to SEQ ID NO: 539247
  misc_feature: HIJSMM301B7OWO.15.34.D01.1.454.light.4.raw

SEQ ID NO: 551339 - DNA, 444 bp, Homo sapiens; identical to SEQ ID NO: 535027
  misc_feature: HIJSMM301EASQ5.8.73.G07.1.454.light.4.raw

SEQ ID NO: 551340 - DNA, 343 bp, Homo sapiens
  misc_feature: HIJSMM301ALN7H.12.87.H10.1.454.light.4.raw
atacgacgtacacgaccggtgctcgatttagcagtactgcgttgggggaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccgccctcctctacgtcgtat

SEQ ID NO: 551341 - DNA, 504 bp, Homo sapiens
  misc_feature: HIJSMM301CJUVJ.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggaccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctgacacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactc

SEQ ID NO: 551342 - DNA, 509 bp, Homo sapiens; identical to SEQ ID NO: 539359
  misc_feature: HIJSMM301BTCCX.47.85.H08.1.454.light.4.raw

SEQ ID NO: 551343 - DNA, 484 bp, Homo sapiens; identical to SEQ ID NO: 535400
  misc_feature: HIJSMM301AOA6E.46.26.C04.1.454.light.4.raw

SEQ ID NO: 551344 - DNA, 482 bp, Homo sapiens; identical to SEQ ID NO: 535796
  misc_feature: HIJSMM301DNVXL.51.64.F09.1.454.light.4.raw

SEQ ID NO: 551345 - DNA, 485 bp, Homo sapiens
  misc_feature: HIJSMM301BYRZL.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacg

SEQ ID NO: 551346 - DNA, 510 bp, Homo sapiens
  misc_feature: HIJSMM301BCAXV.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctcgttcccg

SEQ ID NO: 551347 - DNA, 488 bp, Homo sapiens
  misc_feature: HIJSMM301DPQEN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaaggacacgactggagattaaacgaactgtggctgcaccatctgtcttcat

SEQ ID NO: 551348 - DNA, 495 bp, Homo sapiens
  misc_feature: HIJSMM301AIOWC.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgctagtttattactgtcagcagcgtagcaactggcctcggacgttcggccgaacgggaccgaaagtaggacatcaagcgaactgtggctgcaccatctgt

SEQ ID NO: 551349 - DNA, 509 bp, Homo sapiens
  misc_feature: HIJSMM301BT4NZ.13.38.D05.1.454.light.4.raw
tcacgtactacacgaccggtgctcgatttagtatctgatagttgggtttgggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaagcccccaaactcataatttttactgtcagtcatcggccctcaggggtttctaatcgtttctctggctccaagtctggcaacacggcctccctgaccatctctgggctccaggctgaagacgaggctgattattactgcagctcatatacaagcggcagctctctttatctcttcggaggtgggaccaaggtcaccgtcctaagtcagcccaaggccaacccactgtcact

SEQ ID NO: 551350 - DNA, 495 bp, Homo sapiens; identical to SEQ ID NO: 536931
  misc_feature: HIJSMM301DYF93.10.33.C11.1.454.light.4.raw

SEQ ID NO: 551351 - DNA, 504 bp, Homo sapiens
  misc_feature: HIJSMM301DVBD4.52.53.E09.1.454.light.4.raw
cgcagtacgacacgaccggtgctcgatttagagagagtgtgttgggtttgggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 551352 - DNA, 498 bp, Homo sapiens
  misc_feature: HIJSMM301EWD86.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctcg

SEQ ID NO: 551353 - DNA, 383 bp, Homo sapiens; identical to SEQ ID NO: 447524
  misc_feature: HIJSMM301DKCV5.41.26.C04.1.454.light.4.raw

SEQ ID NO: 551354 - DNA, 517 bp, Homo sapiens
  misc_feature: HIJSMM301BT9D2.19.80.H03.1.454.light.4.raw
  modified_base (505)..(505): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgttcccnccctcctccacg

SEQ ID NO: 551355 - DNA, 447 bp, Homo sapiens; identical to SEQ ID NO: 535882
  misc_feature: HIJSMM301BI23Q.18.9.A09.1.454.light.4.raw
  modified_base (429)..(429): a, c, t, g, unknown or other

SEQ ID NO: 551356 - DNA, 493 bp, Homo sapiens; identical to SEQ ID NO: 536185
  misc_feature: HIJSMM301A86ON.9.19.B08.1.454.light.4.raw

SEQ ID NO: 551357 - DNA, 502 bp, Homo sapiens
  misc_feature: HIJSMM301BR2YP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactgtggctgcaccatctgtcttcatcttccccg

SEQ ID NO: 551358 - DNA, 479 bp, Homo sapiens; identical to SEQ ID NO: 536050
  misc_feature: HIJSMM301C5SR7.5.73.G07.1.454.light.4.raw

SEQ ID NO: 551359 - DNA, 443 bp, Homo sapiens
  misc_feature: HIJSMM301BXR4H.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtacccgtggacgttgcaggacgaa

SEQ ID NO: 551360 - DNA, 486 bp, Homo sapiens; identical to SEQ ID NO: 535043
  misc_feature: HIJSMM301BH4BB.46.35.D02.1.454.light.4.raw

SEQ ID NO: 551361 - DNA, 508 bp, Homo sapiens
  misc_feature: HIJSMM301BZKC8.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatggtgctggcatttcggtcttcggcggagggaccgaaagctgaccgtcctaggtcagcccaaggctgccccctccggt

SEQ ID NO: 551362 - DNA, 487 bp, Homo sapiens; identical to SEQ ID NO: 551272
  misc_feature: HIJSMM301DDW0O.4.59.F04.1.454.light.4.raw

SEQ ID NO: 551363 - DNA, 500 bp, Homo sapiens; identical to SEQ ID NO: 535310
  misc_feature: HIJSMM301BXTX2.47.66.F11.1.454.light.4.raw

SEQ ID NO: 551364 - DNA, 500 bp, Homo sapiens
  misc_feature: HIJSMM301A314V.43.25.C03.1.454.light.4.raw
tgtgagtagtcacgaccggtgctcgatttagtagtgtagatttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtggggtcaggcactgatttcacactgaagatcagcagggtggaggctgaggatgttggggtttattactgcatgcaaggtacacactggcccgtcaccttcggccaagggacacgactggagattaaacgaactgtggctgcaccatctgtt

SEQ ID NO: 551365 - DNA, 502 bp, Homo sapiens
  misc_feature: HIJSMM301CYAPD.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggcctcgggaccaaagtggatatcaaacgaactagtggctgcaccatctgtcttcatt

SEQ ID NO: 551366 - DNA, 471 bp, Homo sapiens; identical to SEQ ID NO: 536321
  misc_feature: HIJSMM301BFOJN.15.8.A08.1.454.light.4.raw

SEQ ID NO: 551367 - DNA, 491 bp, Homo sapiens; identical to SEQ ID NO: 536211
  misc_feature: HIJSMM301CU6ZX.16.53.E09.1.454.light.4.raw

SEQ ID NO: 551368 - DNA, 493 bp, Homo sapiens
  misc_feature: HIJSMM301B53CM.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttccgc

SEQ ID NO: 551369 - DNA, 444 bp, Homo sapiens; identical to SEQ ID NO: 535192
  misc_feature: HIJSMM301DX5XR.5.9.A09.1.454.light.4.raw

SEQ ID NO: 551370 - DNA, 479 bp, Homo sapiens
  misc_feature: HIJSMM301ARCVC.48.55.E11.1.454.light.4.raw
agtatacatacacgaccggtgctcgatttagcactcgcacgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 551371 - DNA, 484 bp, Homo sapiens; identical to SEQ ID NO: 535400
  misc_feature: HIJSMM301AOFSD.46.26.C04.1.454.light.4.raw

SEQ ID NO: 551372 - DNA, 492 bp, Homo sapiens
  misc_feature: HIJSMM301CWRWY.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactgggctcaggcggaagatgaggctgactattactgtaactcccgggccagcagtggtaacattgtgatattcggcggagggaccaaggtgaccgtcctacgtcagcccaaggctgccccctcggtcact

SEQ ID NO: 551373 - DNA, 487 bp, Homo sapiens
  misc_feature: HIJSMM301BBS15.14.53.E09.1.454.light.4.raw
cgtctagtaccacgaccggtgctcgatttagagagagtgtgttgggtttgggggggaggcctagctgtgctgtgggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgtcggcggagggaccaagctgaccgtccta

SEQ ID NO: 551374 - DNA, 493 bp, Homo sapiens
  misc_feature: HIJSMM301C6TXO.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggccaaggtggagatcaaacgaactgtggctgcaccat

SEQ ID NO: 551375 - DNA, 484 bp, Homo sapiens
  misc_feature: HIJSMM301A1HGU.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccg

SEQ ID NO: 551376 - DNA, 485 bp, Homo sapiens; identical to SEQ ID NO: 539315
  misc_feature: HIJSMM301CFE1H.3.88.H11.1.454.light.4.raw

SEQ ID NO: 551377 - DNA, 484 bp, Homo sapiens
  misc_feature: HIJSMM301BP64K.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtcaaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagccccg

SEQ ID NO: 551378 - DNA, 489 bp, Homo sapiens; identical to SEQ ID NO: 535091
  misc_feature: HIJSMM301AF26H.47.36.D03.1.454.light.4.raw

SEQ ID NO: 551379 - DNA, 485 bp, Homo sapiens; identical to SEQ ID NO: 535880
  misc_feature: HIJSMM301D4K6U.7.75.G09.1.454.light.4.raw

SEQ ID NO: 551380 - DNA, 495 bp, Homo sapiens
  misc_feature: HIJSMM301D71IZ.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcact

SEQ ID NO: 551381 - DNA, 506 bp, Homo sapiens
  misc_feature: HIJSMM301DHUZH.48.16.B05.1.454.light.4.raw
agtatacatacacgaccggtgctcgatttagagctcacgtaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagcccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgtcttttttgttcggcggagggaccaaactgaccgtcctcggtcggcccaaggctcgcccctcggtcactctccg

SEQ ID NO: 551382 - DNA, 488 bp, Homo sapiens; identical to SEQ ID NO: 535990
  misc_feature: HIJSMM301A53DW.11.28.C06.1.454.light.4.raw

SEQ ID NO: 551383 - DNA, 492 bp, Homo sapiens
  misc_feature: HIJSMM301BQCDV.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccccactgtcta

SEQ ID NO: 551384 - DNA, 504 bp, Homo sapiens
  misc_feature: HIJSMM301DI36I.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacggaccgaacggtggaaagtcaaacgaactagtggctgcaccatctgtctt

SEQ ID NO: 551385 - DNA, 504 bp, Homo sapiens
  misc_feature: HIJSMM301BVJ26.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgatttattattgctgctcatatgcaggtagttacacttatgtcttcggaatttggggacgacggtcaccgtcctaggtcagcccaaggcccaaccccta

SEQ ID NO: 551386 - DNA, 510 bp, Homo sapiens
  misc_feature: HIJSMM301DMYQI.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattactgtgcaacatgggatgacatcctacgtggtgcggtgttcggcggagggaccaagttgaccgtcctgggtcagcccaaggctgccccctcggtca

SEQ ID NO: 551387 - DNA, 496 bp, Homo sapiens
  misc_feature: HIJSMM301D9F36.52.15.B04.1.454.light.4.raw
  modified_base (456)..(456): a, c, t, g, unknown or other
cgcagtacgacacgaccggtgctcgatttagacagtatatatccgcgggcacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctctcctcagggacaacagtcacgttgatcatcagtggagtccgggcagaggacgaggctgactattactgtcaatcaacngacagtagtggtacttatgtgcagttcggcggagggaccg

SEQ ID NO: 551388 - DNA, 494 bp, Homo sapiens; identical to SEQ ID NO: 539894
  misc_feature: HIJSMM301BQ9YK.16.53.E09.1.454.light.4.raw

SEQ ID NO: 551389 - DNA, 521 bp, Homo sapiens
  misc_feature: HIJSMM301CLAZM.49.26.C04.1.454.light.4.raw
agtcgagagacacgaccggtgctcgatttagtctagcgactttgggtttggggggctcaggaggcagagctctgggaatctcaccatggcctggacccctctcctgctccccctcctcactttctgcacagtctctggggcctcctatgagctgacacagccaccctcggtgtcggtgtccccaggacaaacggccaggataacctgctctggagatgcattgaccaaaaaaatatgcttgttggtaccagaagaagtcaggccaggcccctgtactggtcatctacgaggacagtaaacgaccctccgggatccctgcgagattctctgcctctagttcagggacaatggccaccttgactatcagtggggcccaggtggaggatgaagctgactactattgttactcaacagacagcagtgccgagggggtcttcggcggagggaccaagctgaccgtcctaggtcagcccaaggctgccccctcggtcactctgttcccaccctcctctctctcgact

SEQ ID NO: 551390 - DNA, 507 bp, Homo sapiens
  misc_feature: HIJSMM301CKKQ5.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccgggatgaggccgactattactgtcaggtgtgggctggtgataatgatcatgcgggggtgttcggcggagggaccaagctgaccgtcctaagtcagcccaaggctgccccctcggtcactctcg

SEQ ID NO: 551391 - DNA, 486 bp, Homo sapiens
  misc_feature: HIJSMM301C78N1.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcacatctgt

SEQ ID NO: 551392 - DNA, 490 bp, Homo sapiens
  misc_feature: HIJSMM301EIYLJ.43.60.F05.1.454.light.4.raw
tgtgagtagtcacgaccggtgctcgatttagtacgtcatcagggaaaggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgtcgagacgaactacgtggcgtgcaccact

SEQ ID NO: 551393 - DNA, 509 bp, Homo sapiens; identical to SEQ ID NO: 542213
  misc_feature: HIJSMM301C6RXG.17.41.D08.1.454.light.4.raw

SEQ ID NO: 551394 - DNA, 486 bp, Homo sapiens; identical to SEQ ID NO: 535043
  misc_feature: HIJSMM301AEE9L.46.35.D02.1.454.light.4.raw

SEQ ID NO: 551395 - DNA, 525 bp, Homo sapiens
  misc_feature: HIJSMM301BYRZP.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactatactgtcaggtgtggaatggtgattatgattatgtcttcggaactgggaccaaggtcaccgtccctaggtcagcccaacggccaaccccacctcgtcactcctgttctcgccctcctcccgttcg

SEQ ID NO: 551396 - DNA, 508 bp, Homo sapiens; identical to SEQ ID NO: 541327
  misc_feature: HIJSMM301DWEBO.47.85.H08.1.454.light.4.raw

SEQ ID NO: 551397 - DNA, 487 bp, Homo sapiens
  misc_feature: HIJSMM301EF990.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagatttgcagtctatcattgtcagcagtataattggtggcctcggacgttcgccaaggaccgaaggtaggaaatacaaacgaactagtggctgcaccat

SEQ ID NO: 551398 - DNA, 422 bp, Homo sapiens
  misc_feature: HIJSMM301CS20U.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaaccccactgtcactctgttcccgccctcctcagacgtatca

SEQ ID NO: 551399 - DNA, 475 bp, Homo sapiens
  misc_feature: HIJSMM301B03BE.4.79.H02.1.454.light.4.raw
agcactgtagcacgaccggtgctcgatttagtgtcacacgaagggaaaggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctcctcatctctgatgcctccactctgcacggtggcgtcccgccaacgttcagcggcagcggatctgggacagaattcagcctcaccatcagcagcctgcagcctgatgatgttgcaacttactactgtcaacaatataacagttactggacgttcggccaagggaccaaggtggaactcaaacgaactgtggctgca

SEQ ID NO: 551400 - DNA, 516 bp, Homo sapiens; identical to SEQ ID NO: 536108
  misc_feature: HIJSMM301D7KVN.22.30.C08.1.454.light.4.raw

SEQ ID NO: 551401 - DNA, 496 bp, Homo sapiens
  misc_feature: HIJSMM301AIM13.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactagtggctgcaccatctgtcttcatcttccccg

SEQ ID NO: 551402 - DNA, 484 bp, Homo sapiens; identical to SEQ ID NO: 535240
  misc_feature: HIJSMM301A28G0.47.60.F05.1.454.light.4.raw

SEQ ID NO: 551403 - DNA, 506 bp, Homo sapiens
  misc_feature: HIJSMM301A68XE.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcgtcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcattttcccg

SEQ ID NO: 551404 - DNA, 495 bp, Homo sapiens
  misc_feature: HIJSMM301E1NUO.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaaggaccaaggtggaaatcaaacgaactgtggctgcacc

SEQ ID NO: 551405 - DNA, 511 bp, Homo sapiens
  misc_feature: HIJSMM301DDLJX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaaacctagtggctgcaccatctgtcttctatctttccccg

SEQ ID NO: 551406 - DNA, 506 bp, Homo sapiens; identical to SEQ ID NO: 534969
  misc_feature: HIJSMM301AK1QW.18.37.D04.1.454.light.4.raw

SEQ ID NO: 551407 - DNA, 502 bp, Homo sapiens
  misc_feature: HIJSMM301DOFVS.7.71.G05.1.454.light.4.raw
cgtgtctctacacgaccggtgctcgatttagtgtcgtcgcaagagagagggggagaggtaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatct

SEQ ID NO: 551408 - DNA, 486 bp, Homo sapiens; identical to SEQ ID NO: 535043
  misc_feature: HIJSMM301BSNX1.46.35.D02.1.454.light.4.raw

SEQ ID NO: 551409 - DNA, 479 bp, Homo sapiens; identical to SEQ ID NO: 535188
  misc_feature: HIJSMM301BLJ0O.10.74.G08.1.454.light.4.raw

SEQ ID NO: 551410 - DNA, 485 bp, Homo sapiens
  misc_feature: HIJSMM301COYK9.48.34.D01.1.454.light.4.raw
agtatacatacacgaccggtgctcgatttagatcgtctgtgttgggtttgggggctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcacc

SEQ ID NO: 551411 - DNA, 495 bp, Homo sapiens
  misc_feature: HIJSMM301COF8Z.10.17.B06.1.454.light.4.raw
catagtagtgcacgaccggtgctcgatttagtcgatagtgaagggggagggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggcccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 551412 - DNA, 517 bp, Homo sapiens
  misc_feature: HIJSMM301CP6CI.18.78.H01.1.454.light.4.raw
  modified_base (483)..(483): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagacccccaaacctcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctaatgttcgttacggaacggtacggaccgtaaggtccncccgtacgtagtcacgcccgaacggacccaaccc

SEQ ID NO: 551413 - DNA, 465 bp, Homo sapiens; identical to SEQ ID NO: 541152
  misc_feature: HIJSMM301BMZ7W.43.71.G05.1.454.light.4.raw

SEQ ID NO: 551414 - DNA, 497 bp, Homo sapiens
  misc_feature: HIJSMM301BEWP6.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtgggaaatcaaacgaactgtggctgcaccatctgtctt

SEQ ID NO: 551415 - DNA, 493 bp, Homo sapiens; identical to SEQ ID NO: 547772
  misc_feature: HIJSMM301EBFJV.47.64.F09.1.454.light.4.raw

SEQ ID NO: 551416 - DNA, 505 bp, Homo sapiens; identical to SEQ ID NO: 536117
  misc_feature: HIJSMM301B3GC0.8.71.G05.1.454.light.4.raw

SEQ ID NO: 551417 - DNA, 521 bp, Homo sapiens
  misc_feature: HIJSMM301CFRN9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctcgccccctcggtcactctgttcccaccct

SEQ ID NO: 551418 - DNA, 446 bp, Homo sapiens
  misc_feature: HIJSMM301CLOIW.18.9.A09.1.454.light.4.raw
  modified_base (428)..(428): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccnccctcctccatactcgta

SEQ ID NO: 551419 - DNA, 465 bp, Homo sapiens; identical to SEQ ID NO: 541152
  misc_feature: HIJSMM301CKWRC.43.71.G05.1.454.light.4.raw

SEQ ID NO: 551420 - DNA, 500 bp, Homo sapiens; identical to SEQ ID NO: 539362
  misc_feature: HIJSMM301EV3WP.26.26.C04.1.454.light.4.raw

SEQ ID NO: 551421 - DNA, 500 bp, Homo sapiens
  misc_feature: HIJSMM301ESJCH.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 551422 - DNA, 488 bp, Homo sapiens
  misc_feature: HIJSMM301BQG80.51.15.B04.1.454.light.4.raw
cgatcgtatacacgaccggtgctcgatttagacagtatatatccgcgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctccatagtaatggattcagctatttggattggtacctgcagaggccagggcagtctccacagctcctgatctatttgggttctaatcgggccccgggtcctgacaggttcagtggcagtggatcaggcacagattttacactgaaaatcagcagcgtggaggctgaggatgttggggtttattactgcatgcaagctctacaaactcctacgttcggccaagggaccaaggtaggaaatcaaacgaactgtggctgcacc

SEQ ID NO: 551423 - DNA, 502 bp, Homo sapiens
  misc_feature: HIJSMM301AJ2IN.11.31.C09.1.454.light.4.raw
  modified_base (420)..(420): a, c, t, g, unknown or other
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttnttccgtttaatttcggtcggagggaccaaggtggagatcaaacgaactgtggctgcaccatctgtcttcatcttcccgccat

SEQ ID NO: 551424 - DNA, 400 bp, Homo sapiens
  misc_feature: HIJSMM301DLGJ2.16.83.H06.1.454.light.4.raw
tgtactactccacgaccggtgctcgatttagatcacgtgcgtcgcggggtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccaccctcctcgagtagtaca

SEQ ID NO: 551425 - DNA, 529 bp, Homo sapiens
  misc_feature: HIJSMM301E17W0.11.75.G09.1.454.light.4.raw
  modified_base (427)..(427): a, c, t, g, unknown or other
  modified_base (493)..(493): a, c, t, g, unknown or other
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtcccgtgaccggttctctggctccaagtctggctcttccgcctctttggccatcactgggctcgaggctgacgatgaggctgattactactgtctgtcctatgacgacgacctacngaactccggttttcggccgggagggacgtaagactgaccgtccgtaacgttcagacccacggtacncgtccccctcccggtcactctcgttcccgtcccccc

SEQ ID NO: 551426 - DNA, 487 bp, Homo sapiens; identical to SEQ ID NO: 536025
  misc_feature: HIJSMM301AK40C.17.34.D01.1.454.light.4.raw

SEQ ID NO: 551427 - DNA, 454 bp, Homo sapiens; identical to SEQ ID NO: 536347
  misc_feature: HIJSMM301BA9H3.19.86.H09.1.454.light.4.raw

SEQ ID NO: 551428 - DNA, 502 bp, Homo sapiens
  misc_feature: HIJSMM301B1DHU.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgccccctccggtcactctcgttcccgccctcctccactactactg

SEQ ID NO: 551429 - DNA, 486 bp, Homo sapiens; identical to SEQ ID NO: 535043
  misc_feature: HIJSMM301B9OVK.46.35.D02.1.454.light.4.raw

SEQ ID NO: 551430 - DNA, 499 bp, Homo sapiens; identical to SEQ ID NO: 537739
  misc_feature: HIJSMM301C7VGQ.12.86.H09.1.454.light.4.raw

SEQ ID NO: 551431 - DNA, 518 bp, Homo sapiens
  misc_feature: HIJSMM301D3G03.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaacgggaccgaacggtaggaaagtacgaaaacgaaaccgtagtcgggctcgcgacctaa

SEQ ID NO: 551432 - DNA, 513 bp, Homo sapiens
  misc_feature: HIJSMM301BIRMX.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggccaagctgaccgtcctaagtcagcccaaggctgccccctcggtcactctgttcccacctcctcg

SEQ ID NO: 551433 - DNA, 511 bp, Homo sapiens; identical to SEQ ID NO: 535406
  misc_feature: HIJSMM301CUOW2.43.59.F04.1.454.light.4.raw

SEQ ID NO: 551434 - DNA, 491 bp, Homo sapiens
  misc_feature: HIJSMM301DR3QD.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggacttttggccctgggaccaaa

SEQ ID NO: 551435 - DNA, 481 bp, Homo sapiens
  misc_feature: HIJSMM301CO3J1.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaacttcgccagggacacgactggagattaaacgaactgtggctgcaccatctgt

SEQ ID NO: 551436 - DNA, 487 bp, Homo sapiens; identical to SEQ ID NO: 535583
  misc_feature: HIJSMM301EDY6A.22.73.G07.1.454.light.4.raw

SEQ ID NO: 551437 - DNA, 488 bp, Homo sapiens; identical to SEQ ID NO: 536554
  misc_feature: HIJSMM301BINSJ.26.37.D04.1.454.light.4.raw

SEQ ID NO: 551438 - DNA, 517 bp, Homo sapiens
  misc_feature: HIJSMM301BZ9XO.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgcctcctccgt

SEQ ID NO: 551439 - DNA, 505 bp, Homo sapiens
  misc_feature: HIJSMM301ADZ33.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggacccaaactgaccgtcctaggtcagccccaa

SEQ ID NO: 551440 - DNA, 486 bp, Homo sapiens; identical to SEQ ID NO: 537144
  misc_feature: HIJSMM301CANL4.46.35.D02.1.454.light.4.raw

SEQ ID NO: 551441 - DNA, 473 bp, Homo sapiens; identical to SEQ ID NO: 536488
  misc_feature: HIJSMM301CUVE1.12.49.E05.1.454.light.4.raw

SEQ ID NO: 551442 - DNA, 494 bp, Homo sapiens; identical to SEQ ID NO: 534992
  misc_feature: HIJSMM301EEE2J.9.1.A01.1.454.light.4.raw

SEQ ID NO: 551443 - DNA, 521 bp, Homo sapiens
  misc_feature: HIJSMM301CQD7U.52.35.D02.1.454.light.4.raw
cgcagtacgacacgaccggtgctcgatttagcacacgatagttgggtttgggggggtcgtcaggaggcagcgctctcaggacgtcaccaccatggcctgggctctgctcctcctcaccctcctcactcagggcacagggtccgtgggcccagtctgccctgactcagcctccctccgcgtccgggtctcctggacagtcagtcaccatctcctgcactggatccagcagtgacgttggtgcttaatgactttgtctcctggtaccaacaccaccctggcaaagcccccaaactcatcatttttgaggtcactaagcggccctcaggggtccctgatcgcttctctggctcgaagtctggcaacacggcctcctgaccgtctctgggctccaggctgaggatgaggctgattactctgcacctcatatgcaggcgacaacaatttgggggttttcggcggagggaccaaggtggaccgtcctacgtcacgcccaaggcctgcccccctcggtcacctctgtt

SEQ ID NO: 551444 - DNA, 494 bp, Homo sapiens; identical to SEQ ID NO: 534994
  misc_feature: HIJSMM301BVDNP.27.78.H01.1.454.light.4.raw

SEQ ID NO: 551445 - DNA, 488 bp, Homo sapiens
  misc_feature: HIJSMM301CNQLA.14.55.E11.1.454.light.4.raw
  modified_base (426)..(426): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccctnactttcggcggagggaccaaggcggagatcagacgaactgtggctgcaccatctgtcttcta

SEQ ID NO: 551446 - DNA, 451 bp, Homo sapiens
  misc_feature: HIJSMM301DD5DV.4.39.D06.1.454.light.4.raw
agcactgtagcacgaccggtgctcgatttagtgacatctcgcagttctttggggcttctcctggtctctggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgcccattctcgtactactagtgcctt

SEQ ID NO: 551447 - DNA, 479 bp, Homo sapiens; identical to SEQ ID NO: 536050
  misc_feature: HIJSMM301CPYTK.5.73.G07.1.454.light.4.raw

SEQ ID NO: 551448 - DNA, 487 bp, Homo sapiens; identical to SEQ ID NO: 536536
  misc_feature: HIJSMM301AEY1G.26.45.E01.1.454.light.4.raw

SEQ ID NO: 551449 - DNA, 505 bp, Homo sapiens
  misc_feature: HIJSMM301ETKJS.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaacccccgttactttcggtccggagggaccgaacggtggaggatcaaacgaaactagtggctgcaccatctgtcttcatcttccccg

SEQ ID NO: 551450 - DNA, 506 bp, Homo sapiens
  misc_feature: HIJSMM301D2Z4Q.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgtccccccg

SEQ ID NO: 551451 - DNA, 487 bp, Homo sapiens; identical to SEQ ID NO: 536025
  misc_feature: HIJSMM301CIX56.17.34.D01.1.454.light.4.raw

SEQ ID NO: 551452 - DNA, 485 bp, Homo sapiens; identical to SEQ ID NO: 538533
  misc_feature: HIJSMM301BFOTK.47.78.H01.1.454.light.4.raw

SEQ ID NO: 551453 - DNA, 483 bp, Homo sapiens
  misc_feature: HIJSMM301APK7T.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaaactgtggctgcaccatctgtt

SEQ ID NO: 551454 - DNA, 494 bp, Homo sapiens; identical to SEQ ID NO: 535184
  misc_feature: HIJSMM301BQKL5.16.71.G05.1.454.light.4.raw

SEQ ID NO: 551455 - DNA, 506 bp, Homo sapiens; identical to SEQ ID NO: 539705
  misc_feature: HIJSMM301CVTLN.40.67.G01.1.454.light.4.raw

SEQ ID NO: 551456 - DNA, 503 bp, Homo sapiens
  misc_feature: HIJSMM301A5NBA.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttctaagttccttttttgtcttcggaactggaccgaggtcaccgtcctaggtcagcccaaggccaaccccactgtcta

SEQ ID NO: 551457 - DNA, 495 bp, Homo sapiens; identical to SEQ ID NO: 535596
  misc_feature: HIJSMM301CIRSU.10.79.H02.1.454.light.4.raw

SEQ ID NO: 551458 - DNA, 503 bp, Homo sapiens
  misc_feature: HIJSMM301CFZPH.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccatgtca

SEQ ID NO: 551459 - DNA, 485 bp, Homo sapiens
  misc_feature: HIJSMM301DGCV0.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagtattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtctacg

SEQ ID NO: 551460 - DNA, 484 bp, Homo sapiens
  misc_feature: HIJSMM301CIDKT.48.19.B08.1.454.light.4.raw
  modified_base (446)..(446): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaacgcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttggggtnttcggcggagggaccaaggctgaccgtcctaggtcacg

SEQ ID NO: 551461 - DNA, 485 bp, Homo sapiens; identical to SEQ ID NO: 535985
  misc_feature: HIJSMM301C68TI.15.1.A01.1.454.light.4.raw

SEQ ID NO: 551462 - DNA, 500 bp, Homo sapiens
  misc_feature: HIJSMM301BKWNE.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaacgggaccaaggtggaagtacagacgaaactgtggctgcaccatctgtcttcatt

SEQ ID NO: 551463 - DNA, 508 bp, Homo sapiens; identical to SEQ ID NO: 536388
  misc_feature: HIJSMM301BGTOC.11.57.F02.1.454.light.4.raw

SEQ ID NO: 551464 - DNA, 516 bp, Homo sapiens
  misc_feature: HIJSMM301BX75B.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcc

SEQ ID NO: 551465 - DNA, 501 bp, Homo sapiens
  misc_feature: HIJSMM301BFV5H.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttcccacccctcctccacgagagta

SEQ ID NO: 551466 - DNA, 500 bp, Homo sapiens
  misc_feature: HIJSMM301AJ9IJ.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtcccgtgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 551467 - DNA, 495 bp, Homo sapiens
  misc_feature: HIJSMM301ENO39.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccgaagctggagatcaaccgaactgtggctgcaccatctgt

SEQ ID NO: 551468 - DNA, 482 bp, Homo sapiens
  misc_feature: HIJSMM301A5M6C.13.8.A08.1.454.light.4.raw
  modified_base (464)..(464): a, c, t, g, unknown or other
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaacngtggctgcaccatctgtt

SEQ ID NO: 551469 - DNA, 503 bp, Homo sapiens; identical to SEQ ID NO: 538973
  misc_feature: HIJSMM301DTG6O.5.86.H09.1.454.light.4.raw

SEQ ID NO: 551470 - DNA, 484 bp, Homo sapiens
  misc_feature: HIJSMM301CDS68.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccaagctgaccgtcctaggtcagaccccg

SEQ ID NO: 551471 - DNA, 488 bp, Homo sapiens
  misc_feature: HIJSMM301DR11L.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccacgggtggaaatacaaacgaactagtggctgcaccatctgtcttctatt

SEQ ID NO: 551472 - DNA, 500 bp, Homo sapiens; identical to SEQ ID NO: 542669
  misc_feature: HIJSMM301B8UDV.18.11.A11.1.454.light.4.raw

SEQ ID NO: 551473 - DNA, 496 bp, Homo sapiens
  misc_feature: HIJSMM301EL2E5.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaagggaccaaggtaggacgatcaagcgaactgtggctgcaccatctgtctt

SEQ ID NO: 551474 - DNA, 493 bp, Homo sapiens
  misc_feature: HIJSMM301BKRTQ.22.86.H09.1.454.light.4.raw
  modified_base (411)..(411): a, c, t, g, unknown or other
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctcctgaccatctctgggctccaggctgaagatgaggctgattattactgctgctcatttgcaggcgcctacncttgggtgttcggcggagggccaagctgaccgtcctaggtcagcccaaggctgccccctggtcactctgttcccgccctcct

SEQ ID NO: 551475 - DNA, 490 bp, Homo sapiens
  misc_feature: HIJSMM301CQ98M.51.71.G05.1.454.light.4.raw
cgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccca

SEQ ID NO: 551476 - DNA, 484 bp, Homo sapiens; identical to SEQ ID NO: 536395
  misc_feature: HIJSMM301ED1I6.46.35.D02.1.454.light.4.raw

SEQ ID NO: 551477 - DNA, 454 bp, Homo sapiens; identical to SEQ ID NO: 536347
  misc_feature: HIJSMM301CA370.19.86.H09.1.454.light.4.raw

SEQ ID NO: 551478 - DNA, 494 bp, Homo sapiens; identical to SEQ ID NO: 534992
  misc_feature: HIJSMM301ES6VU.9.1.A01.1.454.light.4.raw

SEQ ID NO: 551479 - DNA, 488 bp, Homo sapiens; identical to SEQ ID NO: 535725
  misc_feature: HIJSMM301B6O6D.12.88.H11.1.454.light.4.raw

SEQ ID NO: 551480 - DNA, 493 bp, Homo sapiens; identical to SEQ ID NO: 536185
  misc_feature: HIJSMM301CUUT2.9.19.B08.1.454.light.4.raw

SEQ ID NO: 551481 - DNA, 447 bp, Homo sapiens
  misc_feature: HIJSMM301BXIXG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctctccatactcgta

SEQ ID NO: 551482 - DNA, 508 bp, Homo sapiens; identical to SEQ ID NO: 550253
  misc_feature: HIJSMM301ENUYN.9.55.E11.1.454.light.4.raw

SEQ ID NO: 551483 - DNA, 506 bp, Homo sapiens; identical to SEQ ID NO: 536038
  misc_feature: HIJSMM301BG1O4.7.71.G05.1.454.light.4.raw

SEQ ID NO: 551484 - DNA, 493 bp, Homo sapiens; identical to SEQ ID NO: 535047
  misc_feature: HIJSMM301BFNC2.16.53.E09.1.454.light.4.raw

SEQ ID NO: 551485 - DNA, 503 bp, Homo sapiens
  misc_feature: HIJSMM301CPI42.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgccagggaccgacagtagaatagagacgaactagtggctgcaccactctgtcttctatcttcccgt

SEQ ID NO: 551486 - DNA, 512 bp, Homo sapiens
  misc_feature: HIJSMM301B828X.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcattctgttcccgcctcct

SEQ ID NO: 551487 - DNA, 494 bp, Homo sapiens; identical to SEQ ID NO: 534992
  misc_feature: HIJSMM301D4LVM.9.1.A01.1.454.light.4.raw

SEQ ID NO: 551488 - DNA, 513 bp, Homo sapiens
  misc_feature: HIJSMM301BK91L.40.47.E03.1.454.light.4.raw
tctagcgactcacgaccggtgctcgatttagactcgcgcacagagagaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccgaagctgaccgtcctaggtcagcccaaggctgccccctcggtcactcttcg

SEQ ID NO: 551489 - DNA, 504 bp, Homo sapiens
  misc_feature: HIJSMM301A4F9S.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccccactgtcactctgttcccgccctcctcta

SEQ ID NO: 551490 - DNA, 486 bp, Homo sapiens
  misc_feature: HIJSMM301AEJNV.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggtcggagggaccaagctgaccgtcctaggtcagaccccg

SEQ ID NO: 551491 - DNA, 489 bp, Homo sapiens
  misc_feature: HIJSMM301BB0LQ.48.38.D05.1.454.light.4.raw
agtatacatacacgaccggtgctcgatttagtatctgatagttgggtttgggggctgtgggtccaggaggcagaactcggggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcg

SEQ ID NO: 551492 - DNA, 487 bp, Homo sapiens
  misc_feature: HIJSMM301DSI60.47.80.H03.1.454.light.4.raw
agctcacgtacacgaccggtgctcgatttagctgtgcgtcgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaaggtgggaaatacaaacgaaactgtggctgcacca

SEQ ID NO: 551493 - DNA, 491 bp, Homo sapiens
  misc_feature: HIJSMM301BWBIA.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccaccctcctctacgtcgtat

SEQ ID NO: 551494 - DNA, 488 bp, Homo sapiens; identical to SEQ ID NO: 535990
  misc_feature: HIJSMM301A4Y38.11.28.C06.1.454.light.4.raw

SEQ ID NO: 551495 - DNA, 517 bp, Homo sapiens
  misc_feature: HIJSMM301ARYWJ.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccgccctccctctcgta

SEQ ID NO: 551496 - DNA, 495 bp, Homo sapiens
  misc_feature: HIJSMM301DUSHE.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagtattttgcagtttattactgtcagcagtataatgtacttgggttttattctactttcggccctgggaccaaagtggatttcagacgaactgtggctgcacatctgtcttcta

SEQ ID NO: 551497 - DNA, 448 bp, Homo sapiens
  misc_feature: HIJSMM301EQVQ9.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 551498 - DNA, 479 bp, Homo sapiens; identical to SEQ ID NO: 538734
  misc_feature: HIJSMM301EBO6Y.8.53.E09.1.454.light.4.raw

SEQ ID NO: 551499 - DNA, 487 bp, Homo sapiens
  misc_feature: HIJSMM301B1E19.49.80.H03.1.454.light.4.raw
agtcgagagacacgaccggtgctcgatttagctgtgcgtcgaaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagcccaaggccaacccactgtcactctgttcccgccct

SEQ ID NO: 551500 - DNA, 506 bp, Homo sapiens
  misc_feature: HIJSMM301AVJF4.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaggtggagatcaaacgaactgtggctgcaccatctgtcttcta

SEQ ID NO: 551501 - DNA, 505 bp, Homo sapiens; identical to SEQ ID NO: 535503
  misc_feature: HIJSMM301BHIH7.8.28.C06.1.454.light.4.raw

SEQ ID NO: 551502 - DNA, 489 bp, Homo sapiens
  misc_feature: HIJSMM301ET5KV.4.36.D03.1.454.light.4.raw
agcactgtagcacgaccggtgctcgatttagctgcgtcacgatctctcttgggggcaggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgtttcggccaagggaccaaggtggaaatcaaacgaactgtggctgcacca

SEQ ID NO: 551503 - DNA, 497 bp, Homo sapiens; identical to SEQ ID NO: 539058
  misc_feature: HIJSMM301BRHS0.12.87.H10.1.454.light.4.raw

SEQ ID NO: 551504 - DNA, 492 bp, Homo sapiens
  misc_feature: HIJSMM301DAEEN.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaggtggaaatcaaacgaaactgtggctgcaccat

SEQ ID NO: 551505 - DNA, 499 bp, Homo sapiens
  misc_feature: HIJSMM301AXKSX.41.53.E09.1.454.light.4.raw
tctatactatcacgaccggtgctcgatttagagagagtgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccaccctcctcatagtat

SEQ ID NO: 551506 - DNA, 444 bp, Homo sapiens
  misc_feature: HIJSMM301CMO20.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccttcctcagacgtatca

SEQ ID NO: 551507 - DNA, 490 bp, Homo sapiens; identical to SEQ ID NO: 543909
  misc_feature: HIJSMM301EG1UR.14.55.E11.1.454.light.4.raw

SEQ ID NO: 551508 - DNA, 487 bp, Homo sapiens
  misc_feature: HIJSMM301CLPBZ.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccatcagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcacc

SEQ ID NO: 551509 - DNA, 486 bp, Homo sapiens
  misc_feature: HIJSMM301AOYUX.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccaaactggatatcagacgaactgtgg

SEQ ID NO: 551510 - DNA, 500 bp, Homo sapiens
  misc_feature: HIJSMM301BXUR3.49.82.H05.1.454.light.4.raw
agtcgagagacacgaccggtgctcgattagtcgagctctctcgcggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagtccaaggctgccccctcggt

SEQ ID NO: 551511 - DNA, 493 bp, Homo sapiens; identical to SEQ ID NO: 535084
  misc_feature: HIJSMM301B02U7.47.64.F09.1.454.light.4.raw

SEQ ID NO: 551512 - DNA, 494 bp, Homo sapiens; identical to SEQ ID NO: 534994
  misc_feature: HIJSMM301BZAFG.27.78.H01.1.454.light.4.raw

SEQ ID NO: 551513 - DNA, 508 bp, Homo sapiens
  misc_feature: HIJSMM301C4KTS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaagtacaaacgaactagtggctgcaccatctgtcttctactcttccccg

SEQ ID NO: 551514 - DNA, 417 bp, Homo sapiens
  misc_feature: HIJSMM301DEDZI.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttcccaccctcctccatactcgta

SEQ ID NO: 551515 - DNA, 508 bp, Homo sapiens
  misc_feature: HIJSMM301AJINT.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactagtggctgcaccatctgtt

SEQ ID NO: 551516 - DNA, 474 bp, Homo sapiens; identical to SEQ ID NO: 538587
  misc_feature: HIJSMM301AUM2N.48.28.C06.1.454.light.4.raw

SEQ ID NO: 551517 - DNA, 510 bp, Homo sapiens
  misc_feature: HIJSMM301B1HAG.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaaactgtggctgcaccatctgtcttcat

SEQ ID NO: 551518 - DNA, 498 bp, Homo sapiens
  misc_feature: HIJSMM301DSI0O.9.67.G01.1.454.light.4.raw
tgatacgtctcacgaccggtgctcgatttagagtatacatattgggtttgggggaggaactgctcagttaggacccacgacggaaccatggaagccccagcgcagcttctcttcctcctgctactctggctcccacgataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcat

SEQ ID NO: 551519 - DNA, 421 bp, Homo sapiens; identical to SEQ ID NO: 536457
  misc_feature: HIJSMM301A0FD8.9.34.D01.1.454.light.4.raw

SEQ ID NO: 551520 - DNA, 508 bp, Homo sapiens
  misc_feature: HIJSMM301AJJE5.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtcta

SEQ ID NO: 551521 - DNA, 512 bp, Homo sapiens
  misc_feature: HIJSMM301DFN2F.48.87.H10.1.454.light.4.raw
agtatacatacacgaccggtgctcgatttagcagtactgcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 551522 - DNA, 512 bp, Homo sapiens
  misc_feature: HIJSMM301BOLJ4.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctggtcact

SEQ ID NO: 551523 - DNA, 487 bp, Homo sapiens; identical to SEQ ID NO: 537009
  misc_feature: HIJSMM301CR2S1.12.88.H11.1.454.light.4.raw

SEQ ID NO: 551524 - DNA, 486 bp, Homo sapiens; identical to SEQ ID NO: 535043
  misc_feature: HIJSMM301BJ6HH.46.35.D02.1.454.light.4.raw

SEQ ID NO: 551525 - DNA, 497 bp, Homo sapiens; identical to SEQ ID NO: 535286
  misc_feature: HIJSMM301C798U.18.59.F04.1.454.light.4.raw

SEQ ID NO: 551526 - DNA, 447 bp, Homo sapiens; identical to SEQ ID NO: 535882
  misc_feature: HIJSMM301DDXUU.18.9.A09.1.454.light.4.raw
  modified_base (429)..(429): a, c, t, g, unknown or other

SEQ ID NO: 551527 - DNA, 520 bp, Homo sapiens
  misc_feature: HIJSMM301C9DGE.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 551528 - DNA, 489 bp, Homo sapiens; identical to SEQ ID NO: 536013
  misc_feature: HIJSMM301CP6QU.26.23.C01.1.454.light.4.raw

SEQ ID NO: 551529 - DNA, 488 bp, Homo sapiens; identical to SEQ ID NO: 536554
  misc_feature: HIJSMM301AIFMO.26.37.D04.1.454.light.4.raw

SEQ ID NO: 551530 - DNA, 484 bp, Homo sapiens
  misc_feature: HIJSMM301BWKI1.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatatatgactggttctcgatcaccttcggccaagggacacgactggagattaaacaactgtggctgcaccatctgt

SEQ ID NO: 551531 - DNA, 444 bp, Homo sapiens; identical to SEQ ID NO: 535594
  misc_feature: HIJSMM301AN6PV.9.9.A09.1.454.light.4.raw

SEQ ID NO: 551532 - DNA, 509 bp, Homo sapiens; identical to SEQ ID NO: 535670
  misc_feature: HIJSMM301CS5TE.47.23.C01.1.454.light.4.raw

SEQ ID NO: 551533 - DNA, 502 bp, Homo sapiens
  misc_feature: HIJSMM301EUJ6C.48.57.F02.1.454.light.4.raw
agtatacatacacgaccggtgctcgatttagctcgatatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatctcccg

SEQ ID NO: 551534 - DNA, 489 bp, Homo sapiens
  misc_feature: HIJSMM301AJON2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtggagtatcagacgaa

SEQ ID NO: 551535 - DNA, 495 bp, Homo sapiens
  misc_feature: HIJSMM301CYLZE.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggaccttcggccaacgggacacgactggagattaaacgaactgtggctgca

SEQ ID NO: 551536 - DNA, 486 bp, Homo sapiens; identical to SEQ ID NO: 536553
  misc_feature: HIJSMM301EAQJ7.17.34.D01.1.454.light.4.raw

SEQ ID NO: 551537 - DNA, 480 bp, Homo sapiens
  misc_feature: HIJSMM301CJ7H8.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggtcggagggaccaaggtgcagatcaaacgaactgtgg

SEQ ID NO: 551538 - DNA, 481 bp, Homo sapiens
  misc_feature: HIJSMM301AN84U.49.63.F08.1.454.light.4.raw
agtcgagagacacgaccggtgctcgatttagcgatcgtataaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctggggattttggaacatactactgtcaacacagttacagtataccgtacagttttggccaggggaccaagctggagatcacacgaactgtggctgcacatctgt

SEQ ID NO: 551539 - DNA, 454 bp, Homo sapiens
  misc_feature: HIJSMM301A7PUU.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaaagctgaccgtcctaagtcagcccaaggctgccccctcggtcactctgttcccaccctcctccacgagagta

SEQ ID NO: 551540 - DNA, 524 bp, Homo sapiens
  misc_feature: HIJSMM301C49NW.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccacctgtcactctgttcccgccctccctccgtcg

SEQ ID NO: 551541 - DNA, 514 bp, Homo sapiens
  misc_feature: HIJSMM301DOJTH.41.9.A09.1.454.light.4.raw
tctatactatcacgaccggtgctcgatttagcgagacgcgcaggggagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctcg

SEQ ID NO: 551542 - DNA, 444 bp, Homo sapiens; identical to SEQ ID NO: 535594
  misc_feature: HIJSMM301CJ8EH.9.9.A09.1.454.light.4.raw

SEQ ID NO: 551543 - DNA, 480 bp, Homo sapiens
  misc_feature: HIJSMM301A040J.13.59.F04.1.454.light.4.raw
tcacgtactacacgaccggtgctcgatttagtacacacacttagggattgggggcagaagtctctctcagtcaggacacaagcatggacatgagggtccctgctcagctcctgggactcctgctgctctggctcccagataccagatgtgacatccagatgacccagtctccatcctccctgtccgcatctcttggagacagagtcaccgtcacttgccaggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 551544 - DNA, 499 bp, Homo sapiens
  misc_feature: HIJSMM301C4JC1.41.53.E09.1.454.light.4.raw
tctatactatcacgaccggtgctcgatttagagagagtgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccgccctcctcatagtat

SEQ ID NO: 551545 - DNA, 485 bp, Homo sapiens; identical to SEQ ID NO: 539691
  misc_feature: HIJSMM301EYBV3.15.1.A01.1.454.light.4.raw
  modified_base (467)..(467): a, c, t, g, unknown or other

SEQ ID NO: 551546 - DNA, 515 bp, Homo sapiens; identical to SEQ ID NO: 541016
  misc_feature: HIJSMM301BNSHN.43.23.C01.1.454.light.4.raw

SEQ ID NO: 551547 - DNA, 521 bp, Homo sapiens; identical to SEQ ID NO: 538715
  misc_feature: HIJSMM301DC0XS.27.23.C01.1.454.light.4.raw

SEQ ID NO: 551548 - DNA, 486 bp, Homo sapiens
  misc_feature: HIJSMM301AT9H4.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccagggaccgacggtcggagtgtcaagcgaactgtggcgtgcgaccat

SEQ ID NO: 551549 - DNA, 509 bp, Homo sapiens; identical to SEQ ID NO: 535670
  misc_feature: HIJSMM301DGCTE.47.23.C01.1.454.light.4.raw

SEQ ID NO: 551550 - DNA, 512 bp, Homo sapiens
  misc_feature: HIJSMM301D0CUT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaacgggaaccaaggtaggaaatacgaaacgaaactagtggctgcgaccatctgtcttctatcttccccg

SEQ ID NO: 551551 - DNA, 501 bp, Homo sapiens; identical to SEQ ID NO: 536142
  misc_feature: HIJSMM301AXM97.15.1.A01.1.454.light.4.raw

SEQ ID NO: 551552 - DNA, 489 bp, Homo sapiens; identical to SEQ ID NO: 543840
  misc_feature: HIJSMM301DWMVA.12.88.H11.1.454.light.4.raw

SEQ ID NO: 551553 - DNA, 481 bp, Homo sapiens
  misc_feature: HIJSMM301DNNC0.40.61.F06.1.454.light.4.raw
tctagcgactcacgaccggtgctcgatttagctacgctctaagggaaaggggcagtcaggacacagcatggacatgagagtcctcgctcagctcctggggctcctgctgctctgtttcccaggtgccagatgtgacatccagatgacccagtctccatcctcactgtctgcatctgtaggagacagagtcaccatcacttgtcgggcgagtcaagacattagcaactacttagcctggtttcagcagaaaccagggaaagcccctaagtccctgatctctgctgcatccaatttgcaaagtggggtcccatcgagattcagcggcagtggatctggaacaaatttcactctcaccatcaacagcctgcagactggagattttgcaacttattactgtctacaagattctaattaccctcggacgttcggccagggaccgaaagtggatgtcaaccgaactagtggctgcaccatctgtctt

SEQ ID NO: 551554 - DNA, 516 bp, Homo sapiens
  misc_feature: HIJSMM301CAEP9.5.27.C05.1.454.light.4.raw
  modified_base (505)..(505): a, c, t, g, unknown or other
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtctaggtcagccaaggccaacccactgtcactctgttcccnccctcctccgt

SEQ ID NO: 551555 - DNA, 490 bp, Homo sapiens
  misc_feature: HIJSMM301D51FW.10.72.G06.1.454.light.4.raw
catagtagtgcacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 551556 - DNA, 504 bp, Homo sapiens
  misc_feature: HIJSMM301ADXG5.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacaaggctgattacactgctgctcatatgcaggtcgtatctcttatgtcttcggaactgggaccaaggtcaccgtcctaggtcagcccaaggccaacccccactgtcta

SEQ ID NO: 551557 - DNA, 490 bp, Homo sapiens
  misc_feature: HIJSMM301CNDEI.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaagaactgtggctgcaccta

SEQ ID NO: 551558 - DNA, 501 bp, Homo sapiens; identical to SEQ ID NO: 536867
  misc_feature: HIJSMM301ALLOL.5.86.H09.1.454.light.4.raw

SEQ ID NO: 551559 - DNA, 517 bp, Homo sapiens
  misc_feature: HIJSMM301DY278.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttggaccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgagggataaccctacgggccctctgggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtctaggtcagcccaaggctgccccctggtcactctgttcccaccctcctcgacgtagtaca

SEQ ID NO: 551560 - DNA, 478 bp, Homo sapiens
  misc_feature: HIJSMM301BWXMF.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagaatcaaacgaactagtggctgca

SEQ ID NO: 551561 - DNA, 473 bp, Homo sapiens
  misc_feature: HIJSMM301EYYYI.49.78.H01.1.454.light.4.raw
agtcgagagacacgaccggtgctcgatttagtgtgagtagtttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatccgtacacttttggtcctagggaccgaaggctggagtatcagacgaaa

SEQ ID NO: 551562 - DNA, 484 bp, Homo sapiens; identical to SEQ ID NO: 535400
  misc_feature: HIJSMM301AORIF.46.26.C04.1.454.light.4.raw

SEQ ID NO: 551563 - DNA, 447 bp, Homo sapiens; identical to SEQ ID NO: 535020
  misc_feature: HIJSMM301ATW73.18.9.A09.1.454.light.4.raw

SEQ ID NO: 551564 - DNA, 442 bp, Homo sapiens
  misc_feature: HIJSMM301D91A2.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgtttcccaccctcctcgtatctctcg

SEQ ID NO: 551565 - DNA, 505 bp, Homo sapiens
  misc_feature: HIJSMM301AQZ5Z.15.66.F11.1.454.light.4.raw
tctacgtagccacgaccggtgctcgatttagtcacgcgagaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccaccct

SEQ ID NO: 551566 - DNA, 484 bp, Homo sapiens; identical to SEQ ID NO: 535400
  misc_feature: HIJSMM301EA6X2.46.26.C04.1.454.light.4.raw

SEQ ID NO: 551567 - DNA, 522 bp, Homo sapiens; identical to SEQ ID NO: 543352
  misc_feature: HIJSMM301EYUSX.27.23.C01.1.454.light.4.raw

SEQ ID NO: 551568 - DNA, 463 bp, Homo sapiens; identical to SEQ ID NO: 535062
  misc_feature: HIJSMM301EI16T.11.73.G07.1.454.light.4.raw

SEQ ID NO: 551569 - DNA, 510 bp, Homo sapiens
  misc_feature: HIJSMM301ALSDE.7.59.F04.1.454.light.4.raw
cgtgtctctacacgaccggtgctcgatttagtacacacacttagggattgggggaggtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggtacgttcggtccgaacggaccgacgggtggaaagtacaaacgaaactgtggctgcaccaatctgttcttctattccc

SEQ ID NO: 551570 - DNA, 485 bp, Homo sapiens; identical to SEQ ID NO: 536630
  misc_feature: HIJSMM301C4ZE2.13.56.F01.1.454.light.4.raw

SEQ ID NO: 551571 - DNA, 481 bp, Homo sapiens
  misc_feature: HIJSMM301C8AC1.41.60.F05.1.454.light.4.raw
tctatactatcacgaccggtgctcgatttagtacgtcatcagggaaagggggatcaggactcctcagttcaccttctcacaatgaggctccctgctcagctcctggggctgctaatgctctgggtctctggatccagtggggatattgtgatgactcagtctccactctccctgtccgtcagccctggagagccggcctccatctcctgcaggtctagtcagagcctcctgtattctaatggatacagtaatttgaattggtacgtgcggaagccagggcagtctccacagctcctgatatattgggcttctcatcgggcctccggggtccctgacaggttcagtggcagtgggtcaggcacagattttactctgcacatcagcagagtggaggctgaggatgctgcgacttattactgcatgcaacctctacaaactgtgtggacgttcggccaggggaccagggtggaaatcaagcgaa

SEQ ID NO: 551572 - DNA, 517 bp, Homo sapiens
  misc_feature: HIJSMM301B227G.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtgggagataacgaaacgaacgtggtggctcgaccactactctcgtt

SEQ ID NO: 551573 - DNA, 503 bp, Homo sapiens
  misc_feature: HIJSMM301CAM4P.43.38.D05.1.454.light.4.raw
tgtgagtagtcacgaccggtgctcgatttagtatctgatagttgggtttggggtgctcgatttagtatctgatagttgggtttggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtccctcaaggttcagcggcagtgcatctgggacagatttcactctcaccatcagcagcctgcagcctgatgattttgcaacttattactgtcaacagtataatagttacccctggacgttcggccaagggaccagggtggaatacaaacgaact

SEQ ID NO: 551574 - DNA, 496 bp, Homo sapiens
  misc_feature: HIJSMM301A6RKD.41.16.B05.1.454.light.4.raw
tctatactatcacgaccggtgctcgatttagagctcacgtaaggggaggaactgctcagttaggacccagacggaaccatggaagccccacgcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggtccaggggaccaacgctcgagatcaaacgaaactgtggctgcaccatctgtcttcatcttcccg

SEQ ID NO: 551575 - DNA, 511 bp, Homo sapiens; identical to SEQ ID NO: 537464
  misc_feature: HIJSMM301BMXPG.7.34.D01.1.454.light.4.raw

SEQ ID NO: 551576 - DNA, 497 bp, Homo sapiens; identical to SEQ ID NO: 535740
  misc_feature: HIJSMM301C79XU.3.71.G05.1.454.light.4.raw

SEQ ID NO: 551577 - DNA, 485 bp, Homo sapiens; identical to SEQ ID NO: 535648
  misc_feature: HIJSMM301CLK70.17.36.D03.1.454.light.4.raw

SEQ ID NO: 551578 - DNA, 490 bp, Homo sapiens; identical to SEQ ID NO: 535936
  misc_feature: HIJSMM301EHBIH.16.68.G02.1.454.light.4.raw

SEQ ID NO: 551579 - DNA, 513 bp, Homo sapiens
  misc_feature: HIJSMM301AWK6F.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactgtcact

SEQ ID NO: 551580 - DNA, 492 bp, Homo sapiens
  misc_feature: HIJSMM301CQMOB.49.41.D08.1.454.light.4.raw
agtcgagagacacgaccggtgctcgatttagtcacgcgagaaagggaaagggggatcaggactcctcagttcacctcctcacaatgaggctccctgctcagctcctggggctgctaatgctctgggtctctggatccagtgggggtattgtgatgactcagtctccactctccctgcccgtcacccctggagagtcggcctccatctcctgcaggtctagtcagagcctcctatatagggatggatacaactatttggattggtacgtgcagaagccagggaagcctccacagctcctgatctatctggcttctaatcgggcctccggggtccctgacaggttcagcggcagtgtgtccggcacagattttacactaaaatcagcagagtggaggctgacgatattggggtttattactgcatgcaagcaatacaccgcctcactttcggcggagggaccacactggagatcaaacgaactgtggctgcacc

SEQ ID NO: 551581 - DNA, 500 bp, Homo sapiens; identical to SEQ ID NO: 542309
  misc_feature: HIJSMM301D1F8J.12.86.H09.1.454.light.4.raw

SEQ ID NO: 551582 - DNA, 508 bp, Homo sapiens; identical to SEQ ID NO: 536388
  misc_feature: HIJSMM301D4SIM.11.57.F02.1.454.light.4.raw

SEQ ID NO: 551583 - DNA, 424 bp, Homo sapiens
  misc_feature: HIJSMM301CQ8TX.9.34.D01.1.454.light.4.raw
  modified_base (411)..(411): a, c, t, g, unknown or other
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcagggtccctgaccgattctccggctccaagtctggcacatcagcctccctggccatcactgggctccaggctgaggatgaggctgactattactgccagtcgtatgacagtggcctaaagtaacatcgtcttcggaactgggaccaaaggtcaccgtcctgggtcaagcccaaaggccaaccccactgtcactctgttcccaaccccncctcagagtatca

SEQ ID NO: 551584 - DNA, 481 bp, Homo sapiens; identical to SEQ ID NO: 535993
  misc_feature: HIJSMM301D4WE0.21.25.C03.1.454.light.4.raw

SEQ ID NO: 551585 - DNA, 484 bp, Homo sapiens
  misc_feature: HIJSMM301C6DBV.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgttttcagggtccagctctggggctgagcgctacctcaccatctccagcctccagtctgaggatgaggctgactattactgtcagacctggggcactggttatgtggttttcggcggagggaccaagctgaccgtcctaggtcagcccaaggctcg

SEQ ID NO: 551586 - DNA, 505 bp, Homo sapiens
  misc_feature: HIJSMM301A8IYN.10.68.G02.1.454.light.4.raw
catagtagtgcacgaccggtgctcgatttagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattcctccggctccagctcagggacagtggcctccttgactatcagtgggcccgaggggtcgatgaggctgactactacttgtttctcgactgacttcactggtaaacgttggctgttcggcggagggaccaagctgaccgtcctgcgtcagcccaaggctcgccccctcggtcacttcc

SEQ ID NO: 551587 - DNA, 476 bp, Homo sapiens
  misc_feature: HIJSMM301AIUXQ.4.63.F08.1.454.light.4.raw
  modified_base (452)..(452): a, c, t, g, unknown or other
agcactgtagcacgaccggtgctcgatttagcgatcgtataagggggagtcagtctcagtcaggacacagcatggacatgagggtccccgcctcagctcctggggctcctgctactctggctccgaggtgccagatgtgacatccagatgacccagtctccatcctccctgtctgcatctgtaggagacagagtcaccatcacttgccgtacaagtcagagcattaacatctatttaaattggtatcagcagcaatcagggaaagcccctaaactcctgatctatgatggatccactttggaacatggggtcccttcaaggttcagtggcagtggatctgggacagagttcactctcaccatcagccgtctgcaacctgaagattttgcaacttactactgtcaacagagttacaatctcccgctcactttcggcggagggacgaaggtggngatcaaacgaactgtggctgcacc

SEQ ID NO: 551588 - DNA, 493 bp, Homo sapiens; identical to SEQ ID NO: 535745
  misc_feature: HIJSMM301EMHWE.47.78.H01.1.454.light.4.raw

SEQ ID NO: 551589 - DNA, 484 bp, Homo sapiens
  misc_feature: HIJSMM301CO6P1.47.42.D09.1.454.light.4.raw
agctcacgtacacgaccggtgctcgatttagacacatacgcagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 551590 - DNA, 489 bp, Homo sapiens; identical to SEQ ID NO: 535139
  misc_feature: HIJSMM301BOLGJ.14.55.E11.1.454.light.4.raw

SEQ ID NO: 551591 - DNA, 497 bp, Homo sapiens; identical to SEQ ID NO: 536376
  misc_feature: HIJSMM301AVREA.22.9.A09.1.454.light.4.raw

SEQ ID NO: 551592 - DNA, 485 bp, Homo sapiens
  misc_feature: HIJSMM301B2B8I.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaagtggatatcaaacgaactgtggctgcaccatctgtt

SEQ ID NO: 551593 - DNA, 488 bp, Homo sapiens
  misc_feature: HIJSMM301DJB5S.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaagtcaaacgaactgtggctgcaccatctgtcttcta

SEQ ID NO: 551594 - DNA, 479 bp, Homo sapiens; identical to SEQ ID NO: 537163
  misc_feature: HIJSMM301EAXUA.13.73.G07.1.454.light.4.raw

SEQ ID NO: 551595 - DNA, 504 bp, Homo sapiens
  misc_feature: HIJSMM301A6IJD.3.4.A04.1.454.light.4.raw
agacgcactccacgaccggtgctcgatttagagtagtgatcaggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaaatcaaacgaaacctagtggctgcaccatctgtcttcatt

SEQ ID NO: 551596 - DNA, 495 bp, Homo sapiens; identical to SEQ ID NO: 535821
  misc_feature: HIJSMM301AXUFV.3.31.C09.1.454.light.4.raw

SEQ ID NO: 551597 - DNA, 477 bp, Homo sapiens
  misc_feature: HIJSMM301AG87Y.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcatatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctgaccgtccta

SEQ ID NO: 551598 - DNA, 505 bp, Homo sapiens; identical to SEQ ID NO: 542754
  misc_feature: HIJSMM301C2549.4.57.F02.1.454.light.4.raw

SEQ ID NO: 551599 - DNA, 495 bp, Homo sapiens
  misc_feature: HIJSMM301B7ACV.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctcggaccgaaacgtaggagatcaaacgaacctagtggcgtcg

SEQ ID NO: 551600 - DNA, 484 bp, Homo sapiens
  misc_feature: HIJSMM301CTXIG.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgactgtggctgcaccatctgt

SEQ ID NO: 551601 - DNA, 484 bp, Homo sapiens; identical to SEQ ID NO: 535240
  misc_feature: HIJSMM301BXBF0.47.60.F05.1.454.light.4.raw

SEQ ID NO: 551602 - DNA, 444 bp, Homo sapiens; identical to SEQ ID NO: 535856
  misc_feature: HIJSMM301BQDFE.9.9.A09.1.454.light.4.raw

SEQ ID NO: 551603 - DNA, 489 bp, Homo sapiens
  misc_feature: HIJSMM301AE8GD.52.78.H01.1.454.light.4.raw
cgcagtacgacacgaccggtgctcgatttagtgtgagtagtttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtcttcta

SEQ ID NO: 551604 - DNA, 509 bp, Homo sapiens
  misc_feature: HIJSMM301C9QY9.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctcgggaccaaggtggaggatcaaacgaactgtggctgcaccatctgtcttcta

SEQ ID NO: 551605 - DNA, 500 bp, Homo sapiens
  misc_feature: HIJSMM301A7H6S.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctcgttcccaccctcctctgtcgagcgt

SEQ ID NO: 551606 - DNA, 518 bp, Homo sapiens; identical to SEQ ID NO: 539372
  misc_feature: HIJSMM301A0N02.7.86.H09.1.454.light.4.raw

SEQ ID NO: 551607 - DNA, 483 bp, Homo sapiens; identical to SEQ ID NO: 545057
  misc_feature: HIJSMM301EVN7F.48.37.D04.1.454.light.4.raw

SEQ ID NO: 551608 - DNA, 495 bp, Homo sapiens; identical to SEQ ID NO: 538651
  misc_feature: HIJSMM301DHQ7Y.10.79.H02.1.454.light.4.raw

SEQ ID NO: 551609 - DNA, 447 bp, Homo sapiens
  misc_feature: HIJSMM301CO13W.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 551610 - DNA, 494 bp, Homo sapiens; identical to SEQ ID NO: 534994
  misc_feature: HIJSMM301BO0U5.27.78.H01.1.454.light.4.raw

SEQ ID NO: 551611 - DNA, 454 bp, Homo sapiens; identical to SEQ ID NO: 536846
  misc_feature: HIJSMM301DZ59G.18.78.H01.1.454.light.4.raw

SEQ ID NO: 551612 - DNA, 515 bp, Homo sapiens
  misc_feature: HIJSMM301EPAEX.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcact

SEQ ID NO: 551613 - DNA, 508 bp, Homo sapiens; identical to SEQ ID NO: 536388
  misc_feature: HIJSMM301C2VWN.11.57.F02.1.454.light.4.raw

SEQ ID NO: 551614 - DNA, 483 bp, Homo sapiens
  misc_feature: HIJSMM301ATWB9.40.10.A10.1.454.light.4.raw
tctagcgactcacgaccggtgctcgatttagcgtcgatctcagggggagtcagacccacctcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccgagggaccgaaacgtggatgtcaaccgaaaccgtgttggctgcacca

SEQ ID NO: 551615 - DNA, 444 bp, Homo sapiens
  misc_feature: HIJSMM301DRC9J.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggccatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 551616 - DNA, 492 bp, Homo sapiens; identical to SEQ ID NO: 536010
  misc_feature: HIJSMM301D40K0.10.20.B09.1.454.light.4.raw

SEQ ID NO: 551617 - DNA, 501 bp, Homo sapiens
  misc_feature: HIJSMM301DLB5O.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattactactgctgctcctttgcaggcgcctctgtctcaggcagctatgtcttcggaactgggaccgaagtgaccgtcctgggtcagcccaagg

SEQ ID NO: 551618 - DNA, 489 bp, Homo sapiens; identical to SEQ ID NO: 535139
  misc_feature: HIJSMM301C20DK.14.55.E11.1.454.light.4.raw

SEQ ID NO: 551619 - DNA, 483 bp, Homo sapiens; identical to SEQ ID NO: 544786
  misc_feature: HIJSMM301B5ZR4.46.26.C04.1.454.light.4.raw

SEQ ID NO: 551620 - DNA, 493 bp, Homo sapiens; identical to SEQ ID NO: 538503
  misc_feature: HIJSMM301C4YMA.9.1.A01.1.454.light.4.raw

SEQ ID NO: 551621 - DNA, 490 bp, Homo sapiens
  misc_feature: HIJSMM301D3IRR.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccaaggtgaccgtcctaggtcagccc

SEQ ID NO: 551622 - DNA, 485 bp, Homo sapiens; identical to SEQ ID NO: 538956
  misc_feature: HIJSMM301A4U7I.40.69.G03.1.454.light.4.raw

SEQ ID NO: 551623 - DNA, 484 bp, Homo sapiens
  misc_feature: HIJSMM301C7HDL.13.59.F04.1.454.light.4.raw
  modified_base (435)..(435): a, c, t, g, unknown or other
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttatcctggtatcagcagaagccagggagagtcccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgntcattttcggcggagggaccaaggtgcagatcaaagaactgtggctgca

SEQ ID NO: 551624 - DNA, 498 bp, Homo sapiens
  misc_feature: HIJSMM301DOSBJ.22.14.B03.1.454.light.4.raw
  modified_base (434)..(434): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattanattcctccttcagacgttcggccaagggaccaaggtggaaatcaaaacgaactgtggctgcacc

SEQ ID NO: 551625 - DNA, 503 bp, Homo sapiens
  misc_feature: HIJSMM301DDKSI.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatt

SEQ ID NO: 551626 - DNA, 494 bp, Homo sapiens
  misc_feature: HIJSMM301A58S9.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcacgtcctaggtcagcccaaggccaaccca

SEQ ID NO: 551627 - DNA, 509 bp, Homo sapiens
  misc_feature: HIJSMM301CNU2E.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcca

SEQ ID NO: 551628 - DNA, 461 bp, Homo sapiens
  misc_feature: HIJSMM301AY4LY.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacagtaagggggacggatccctgatcgcttctcaggctccagctctggggctgagcgctacctcaccatctccagcctccagtctgaggatgaggctgactattactgtcagacctggggcactggcaatagtt

SEQ ID NO: 551629 - DNA, 496 bp, Homo sapiens; identical to SEQ ID NO: 535109
  misc_feature: HIJSMM301DQT59.16.78.H01.1.454.light.4.raw

SEQ ID NO: 551630 - DNA, 503 bp, Homo sapiens
  misc_feature: HIJSMM301BLJJK.5.86.H09.1.454.light.4.raw
atcagacacgcacgaccggtgctcgatttagtgctatagacttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 551631 - DNA, 447 bp, Homo sapiens; identical to SEQ ID NO: 535201
  misc_feature: HIJSMM301EAD9B.18.9.A09.1.454.light.4.raw

SEQ ID NO: 551632 - DNA, 417 bp, Homo sapiens; identical to SEQ ID NO: 541011
  misc_feature: HIJSMM301AN096.18.78.H01.1.454.light.4.raw

SEQ ID NO: 551633 - DNA, 503 bp, Homo sapiens
  misc_feature: HIJSMM301B9MNG.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcacaatcagcagtctgcaacctgaagattttgcaacttattactgtcaacagagtttcagtacgcggacgttcggccaagggaccgaaggtggaaagtacaaacgaactagtggctgcaccatctgtcttcatcttccccg

SEQ ID NO: 551634 - DNA, 500 bp, Homo sapiens; identical to SEQ ID NO: 535310
  misc_feature: HIJSMM301BART4.47.66.F11.1.454.light.4.raw

SEQ ID NO: 551635 - DNA, 513 bp, Homo sapiens
  misc_feature: HIJSMM301DD9O1.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccc

SEQ ID NO: 551636 - DNA, 485 bp, Homo sapiens
  misc_feature: HIJSMM301CGVLG.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagccaaggccaaccca

SEQ ID NO: 551637 - DNA, 494 bp, Homo sapiens; identical to SEQ ID NO: 535629
  misc_feature: HIJSMM301DI0OH.4.27.C05.1.454.light.4.raw

SEQ ID NO: 551638 - DNA, 499 bp, Homo sapiens; identical to SEQ ID NO: 536578
  misc_feature: HIJSMM301A52WT.22.27.C05.1.454.light.4.raw

SEQ ID NO: 551639 - DNA, 503 bp, Homo sapiens
  misc_feature: HIJSMM301D3NAI.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccggggccactttcggccctggaccaggtggagatcaacgaactgtggctgcaccatctgtcttcta

SEQ ID NO: 551640 - DNA, 522 bp, Homo sapiens
  misc_feature: HIJSMM301ENZ4N.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgggtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccct

SEQ ID NO: 551641 - DNA, 497 bp, Homo sapiens; identical to SEQ ID NO: 535740
  misc_feature: HIJSMM301A7HWR.3.71.G05.1.454.light.4.raw

SEQ ID NO: 551642 - DNA, 510 bp, Homo sapiens
  misc_feature: HIJSMM301AKBB5.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcc

SEQ ID NO: 551643 - DNA, 505 bp, Homo sapiens; identical to SEQ ID NO: 536254
  misc_feature: HIJSMM301BZM2F.7.71.G05.1.454.light.4.raw

SEQ ID NO: 551644 - DNA, 495 bp, Homo sapiens; identical to SEQ ID NO: 538651
  misc_feature: HIJSMM301EXNNA.10.79.H02.1.454.light.4.raw

SEQ ID NO: 551645 - DNA, 516 bp, Homo sapiens
  misc_feature: HIJSMM301AITVL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccacggacgaacggtaggaagtacgaaacgaactagtaggcgtgcgaccactctgtcttctatcttcccgtcccact

SEQ ID NO: 551646 - DNA, 494 bp, Homo sapiens; identical to SEQ ID NO: 534992
  misc_feature: HIJSMM301D85MX.9.1.A01.1.454.light.4.raw

SEQ ID NO: 551647 - DNA, 485 bp, Homo sapiens
  misc_feature: HIJSMM301D1PXM.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcacat

SEQ ID NO: 551648 - DNA, 498 bp, Homo sapiens
  misc_feature: HIJSMM301AFEE5.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggtccaggggaccaagctggagatcaaacgaactgtggtcg

SEQ ID NO: 551649 - DNA, 473 bp, Homo sapiens
  misc_feature: HIJSMM301A4BPC.15.8.A08.1.454.light.4.raw
  modified_base (345)..(345): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgnagtctgaagtattttgctagtttattactgtcagcaatataacaagtggccattcactttcggcccagggaccaaagtggatatcaaacgaactgtggctgcaccatctgtcttcatcttcccgccat

SEQ ID NO: 551650 - DNA, 487 bp, Homo sapiens; identical to SEQ ID NO: 537079
  misc_feature: HIJSMM301CCR02.14.55.E11.1.454.light.4.raw

SEQ ID NO: 551651 - DNA, 447 bp, Homo sapiens; identical to SEQ ID NO: 535201
  misc_feature: HIJSMM301D9YTH.18.9.A09.1.454.light.4.raw

SEQ ID NO: 551652 - DNA, 493 bp, Homo sapiens
  misc_feature: HIJSMM301COPKU.52.42.D09.1.454.light.4.raw
cgcagtacgacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagagacgaggctgactattattgtcaatcaacagacaccattggtacttatgtcttcggaactgcgaccaaggtcaccgtcctgggtcagccaaggccaacccactgtcact

SEQ ID NO: 551653 - DNA, 484 bp, Homo sapiens; identical to SEQ ID NO: 535400
  misc_feature: HIJSMM301BKUNP.46.26.C04.1.454.light.4.raw

SEQ ID NO: 551654 - DNA, 484 bp, Homo sapiens; identical to SEQ ID NO: 535400
  misc_feature: HIJSMM301BVNTZ.46.26.C04.1.454.light.4.raw

SEQ ID NO: 551655 - DNA, 495 bp, Homo sapiens
  misc_feature: HIJSMM301CFNE7.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcatagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 551656 - DNA, 494 bp, Homo sapiens; identical to SEQ ID NO: 535629
  misc_feature: HIJSMM301C8R6H.4.27.C05.1.454.light.4.raw

SEQ ID NO: 551657 - DNA, 490 bp, Homo sapiens; identical to SEQ ID NO: 535936
  misc_feature: HIJSMM301EWVFV.16.68.G02.1.454.light.4.raw

SEQ ID NO: 551658 - DNA, 493 bp, Homo sapiens; identical to SEQ ID NO: 537281
  misc_feature: HIJSMM301D298T.9.1.A01.1.454.light.4.raw

SEQ ID NO: 551659 - DNA, 483 bp, Homo sapiens
  misc_feature: HIJSMM301EOWV3.4.19.B08.1.454.light.4.raw
agcactgtagcacgaccggtgctcgatttagtgagtcagtaaggggggagtcagactcagtcaggacacagcatggacatgagggtccccgctcagctcctggggctcctgctgctctggctcccaggagccgattgtgacatccagttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataatagttattggacgttcggccaggggaccaaggtggaattcaaacgaactagtggctgcaccatctgtctt

SEQ ID NO: 551660 - DNA, 512 bp, Homo sapiens
  misc_feature: HIJSMM301DEFAI.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgcctcctcgctacgtaga

SEQ ID NO: 551661 - DNA, 491 bp, Homo sapiens
  misc_feature: HIJSMM301BZ9UP.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactattctgtcacacgtgggacatgggcactgcgatcttcggcggagggaccaagctgaccgtcctggtcagcccaagctgccccctcggtcact

SEQ ID NO: 551662 - DNA, 510 bp, Homo sapiens; identical to SEQ ID NO: 543290
  misc_feature: HIJSMM301D5835.5.58.F03.1.454.light.4.raw

SEQ ID NO: 551663 - DNA, 485 bp, Homo sapiens; identical to SEQ ID NO: 535688
  misc_feature: HIJSMM301DMAII.19.5.A05.1.454.light.4.raw

SEQ ID NO: 551664 - DNA, 507 bp, Homo sapiens; identical to SEQ ID NO: 550515
  misc_feature: HIJSMM301CY1DM.12.73.G07.1.454.light.4.raw

SEQ ID NO: 551665 - DNA, 486 bp, Homo sapiens; identical to SEQ ID NO: 535290
  misc_feature: HIJSMM301D4XBF.3.12.B01.1.454.light.4.raw

SEQ ID NO: 551666 - DNA, 498 bp, Homo sapiens; identical to SEQ ID NO: 536977
  misc_feature: HIJSMM301EJKRK.11.75.G09.1.454.light.4.raw

SEQ ID NO: 551667 - DNA, 485 bp, Homo sapiens
  misc_feature: HIJSMM301C7J3F.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtcctaggtcagcccaaggctgccccctcggtcta

SEQ ID NO: 551668 - DNA, 485 bp, Homo sapiens; identical to SEQ ID NO: 535880
  misc_feature: HIJSMM301BP9O5.7.75.G09.1.454.light.4.raw

SEQ ID NO: 551669 - DNA, 486 bp, Homo sapiens; identical to SEQ ID NO: 536329
  misc_feature: HIJSMM301AYHKD.21.4.A04.1.454.light.4.raw

SEQ ID NO: 551670 - DNA, 511 bp, Homo sapiens
  misc_feature: HIJSMM301DNBK5.48.34.D01.1.454.light.4.raw
agtatacatacacgaccggtgctcgatttagatcgtctgtgttgggtttggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgcctcct

SEQ ID NO: 551671 - DNA, 467 bp, Homo sapiens
  misc_feature: HIJSMM301AXNC1.41.3.A03.1.454.light.4.raw
tctatactatcacgaccggtgctcgatttagagagcgtcacagagaggaagggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcct

SEQ ID NO: 551672 - DNA, 513 bp, Homo sapiens
  misc_feature: HIJSMM301BRYP4.43.9.A09.1.454.light.4.raw
tgtgagtagtcacgaccggtgctcgatttagcgagacgcgcagggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccaccctcctcactact

SEQ ID NO: 551673 - DNA, 499 bp, Homo sapiens; identical to SEQ ID NO: 539754
  misc_feature: HIJSMM301DIZ6T.11.21.B10.1.454.light.4.raw

SEQ ID NO: 551674 - DNA, 515 bp, Homo sapiens
  misc_feature: HIJSMM301A4RBG.49.21.B10.1.454.light.4.raw
agtcgagagacacgaccggtgctcgatttagtgtcgtcgcaagagaagagggggagtctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccct

SEQ ID NO: 551675 - DNA, 507 bp, Homo sapiens
  misc_feature: HIJSMM301D2RDX.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatacaaacgaactgtggctgcaccatctgtcttca

SEQ ID NO: 551676 - DNA, 498 bp, Homo sapiens
  misc_feature: HIJSMM301AG45E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccctcctctacgttcggacggacggacgaggacggagatacgagacgacgtggtgcgtcgaccacactctcgttcctt

SEQ ID NO: 551677 - DNA, 489 bp, Homo sapiens; identical to SEQ ID NO: 535139
  misc_feature: HIJSMM301DTAXO.14.55.E11.1.454.light.4.raw

SEQ ID NO: 551678 - DNA, 493 bp, Homo sapiens; identical to SEQ ID NO: 549048
  misc_feature: HIJSMM301BZ5TV.16.86.H09.1.454.light.4.raw

SEQ ID NO: 551679 - DNA, 490 bp, Homo sapiens
  misc_feature: HIJSMM301CAQ1I.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccaccctctctacgtcgtat

SEQ ID NO: 551680 - DNA, 446 bp, Homo sapiens; identical to SEQ ID NO: 536106
  misc_feature: HIJSMM301CTECS.18.9.A09.1.454.light.4.raw

SEQ ID NO: 551681 - DNA, 494 bp, Homo sapiens
  misc_feature: HIJSMM301C7M8K.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtgctgcaccatctgtctt

SEQ ID NO: 551682 - DNA, 478 bp, Homo sapiens
  misc_feature: HIJSMM301B5DCQ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagtttgtccagggaccaagctggagatacaacgaa

SEQ ID NO: 551683 - DNA, 454 bp, Homo sapiens; identical to SEQ ID NO: 534964
  misc_feature: HIJSMM301AHB12.19.86.H09.1.454.light.4.raw

SEQ ID NO: 551684 - DNA, 520 bp, Homo sapiens
  misc_feature: HIJSMM301BBA0Q.9.25.C03.1.454.light.4.raw
tgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagccaaggctgccccctcggtcactctgttcccaccctcctc

SEQ ID NO: 551685 - DNA, 489 bp, Homo sapiens; identical to SEQ ID NO: 538498
  misc_feature: HIJSMM301ANU0B.19.71.G05.1.454.light.4.raw

SEQ ID NO: 551686 - DNA, 494 bp, Homo sapiens
  misc_feature: HIJSMM301DC8PY.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgtcatgcaagcaacacactggccgtacacttttggccaggggaccaagctggagatcaatcgaactgtggc

SEQ ID NO: 551687 - DNA, 513 bp, Homo sapiens
  misc_feature: HIJSMM301CIEWP.53.71.G05.1.454.light.4.raw
cgcgtatacacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagttgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgttccccg

SEQ ID NO: 551688 - DNA, 486 bp, Homo sapiens; identical to SEQ ID NO: 535458
  misc_feature: HIJSMM301AJ9M0.7.75.G09.1.454.light.4.raw

SEQ ID NO: 551689 - DNA, 503 bp, Homo sapiens; identical to SEQ ID NO: 550542
  misc_feature: HIJSMM301B0N92.2.76.G10.1.454.light.4.raw

SEQ ID NO: 551690 - DNA, 472 bp, Homo sapiens
  misc_feature: HIJSMM301AGQ58.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcgaccaagggaccaaggtggaaatacaaacgaactagt

SEQ ID NO: 551691 - DNA, 495 bp, Homo sapiens; identical to SEQ ID NO: 535821
  misc_feature: HIJSMM301DQ9GQ.3.31.C09.1.454.light.4.raw

SEQ ID NO: 551692 - DNA, 493 bp, Homo sapiens; identical to SEQ ID NO: 535047
  misc_feature: HIJSMM301BA4CQ.16.53.E09.1.454.light.4.raw

SEQ ID NO: 551693 - DNA, 487 bp, Homo sapiens; identical to SEQ ID NO: 536006
  misc_feature: HIJSMM301B8ZET.4.64.F09.1.454.light.4.raw

SEQ ID NO: 551694 - DNA, 474 bp, Homo sapiens
  misc_feature: HIJSMM301D3ALB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacgatcaaacgaa

SEQ ID NO: 551695 - DNA, 510 bp, Homo sapiens
  misc_feature: HIJSMM301C6OR3.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtcactctgtt

SEQ ID NO: 551696 - DNA, 494 bp, Homo sapiens; identical to SEQ ID NO: 535828
  misc_feature: HIJSMM301CUDEU.3.36.D03.1.454.light.4.raw

SEQ ID NO: 551697 - DNA, 489 bp, Homo sapiens; identical to SEQ ID NO: 542296
  misc_feature: HIJSMM301CPT6Y.17.21.B10.1.454.light.4.raw

SEQ ID NO: 551698 - DNA, 501 bp, Homo sapiens
  misc_feature: HIJSMM301C2MJW.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcaagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 551699 - DNA, 515 bp, Homo sapiens
  misc_feature: HIJSMM301C8GIM.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctggtcactctgttcccaccctctcacg

SEQ ID NO: 551700 - DNA, 513 bp, Homo sapiens
  misc_feature: HIJSMM301A8CQC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaagtacaaacgaactacgtggctgcaccactctgtcttcctatctttccccg

SEQ ID NO: 551701 - DNA, 504 bp, Homo sapiens
  misc_feature: HIJSMM301D7TIK.12.53.E09.1.454.light.4.raw
atacgacgtacacgaccggtgctcgatttagagagagtgtgttggggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctggtcagcccaaggctgcccctcggtcacctctgttcccgccctcctctacgtcgtat

SEQ ID NO: 551702 - DNA, 494 bp, Homo sapiens; identical to SEQ ID NO: 534992
  misc_feature: HIJSMM301CVZJG.9.1.A01.1.454.light.4.raw

SEQ ID NO: 551703 - DNA, 478 bp, Homo sapiens
  misc_feature: HIJSMM301A9B0W.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactacccaactcacttcgtccctcggacgtgaagtagcgatatgaagaagaactagtggcgt

SEQ ID NO: 551704 - DNA, 495 bp, Homo sapiens
  misc_feature: HIJSMM301ENQZE.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaaactgtggctgcaccatctgtctt

SEQ ID NO: 551705 - DNA, 509 bp, Homo sapiens; identical to SEQ ID NO: 545244
  misc_feature: HIJSMM301CTHN8.51.38.D05.1.454.light.4.raw

SEQ ID NO: 551706 - DNA, 501 bp, Homo sapiens
  misc_feature: HIJSMM301DEPSS.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtccccactgttgtacttttcggcggagggaccaagctgaccgtctaggtcagcccaaggctgccccctcggtcactctgttcccgccctcctcgctacgtaga

SEQ ID NO: 551707 - DNA, 504 bp, Homo sapiens
  misc_feature: HIJSMM301C7KVO.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcacgtcctaagtcagcccaaggccaaccccactgtcactctcgttcccaccct

SEQ ID NO: 551708 - DNA, 505 bp, Homo sapiens; identical to SEQ ID NO: 535987
  misc_feature: HIJSMM301B6N7G.18.37.D04.1.454.light.4.raw

SEQ ID NO: 551709 - DNA, 505 bp, Homo sapiens
  misc_feature: HIJSMM301B0HRW.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaagcagccgatccagcctgcggagcctgtgggcaggtcagcccaaggccaaccccactcgtcactc

SEQ ID NO: 551710 - DNA, 497 bp, Homo sapiens; identical to SEQ ID NO: 535286
  misc_feature: HIJSMM301BHTKL.18.59.F04.1.454.light.4.raw

SEQ ID NO: 551711 - DNA, 474 bp, Homo sapiens
  misc_feature: HIJSMM301EI9KC.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgcttcggaactgggaccaaggtcaccgtcctaagtcagacccc

SEQ ID NO: 551712 - DNA, 444 bp, Homo sapiens
  misc_feature: HIJSMM301DLJS3.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgccccctcggtcactctgttcccaccctcctccgtgtcgat

SEQ ID NO: 551713 - DNA, 488 bp, Homo sapiens
  misc_feature: HIJSMM301BLYQC.43.33.C11.1.454.light.4.raw
tgtgagtagtcacgaccggtgctcgatttagagtgagctcgttgggtttggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggttcagggaccgaagttgaacatcaatcgaactgtggctgcaccat

SEQ ID NO: 551714 - DNA, 494 bp, Homo sapiens; identical to SEQ ID NO: 550126
  misc_feature: HIJSMM301EUJVO.51.35.D02.1.454.light.4.raw

SEQ ID NO: 551715 - DNA, 481 bp, Homo sapiens
  misc_feature: HIJSMM301DB6E9.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggaccaaggtggaggatcaaacgaactagtggtcg

SEQ ID NO: 551716 - DNA, 502 bp, Homo sapiens; identical to SEQ ID NO: 536253
  misc_feature: HIJSMM301ELQXE.21.22.B11.1.454.light.4.raw

SEQ ID NO: 551717 - DNA, 484 bp, Homo sapiens; identical to SEQ ID NO: 535240
  misc_feature: HIJSMM301B31OD.47.60.F05.1.454.light.4.raw

SEQ ID NO: 551718 - DNA, 486 bp, Homo sapiens; identical to SEQ ID NO: 535043
  misc_feature: HIJSMM301BJAF7.46.35.D02.1.454.light.4.raw

SEQ ID NO: 551719 - DNA, 503 bp, Homo sapiens; identical to SEQ ID NO: 538884
  misc_feature: HIJSMM301DSD33.27.78.H01.1.454.light.4.raw

SEQ ID NO: 551720 - DNA, 473 bp, Homo sapiens; identical to SEQ ID NO: 546369
  misc_feature: HIJSMM301CNGOT.18.76.G10.1.454.light.4.raw

SEQ ID NO: 551721 - DNA, 502 bp, Homo sapiens; identical to SEQ ID NO: 541501
  misc_feature: HIJSMM301BZUHU.17.27.C05.1.454.light.4.raw

SEQ ID NO: 551722 - DNA, 499 bp, Homo sapiens; identical to SEQ ID NO: 541101
  misc_feature: HIJSMM301ERTPO.43.34.D01.1.454.light.4.raw

SEQ ID NO: 551723 - DNA, 521 bp, Homo sapiens; identical to SEQ ID NO: 538715
  misc_feature: HIJSMM301EIGOF.27.23.C01.1.454.light.4.raw

SEQ ID NO: 551724 - DNA, 488 bp, Homo sapiens; identical to SEQ ID NO: 535861
  misc_feature: HIJSMM301DJB7H.14.55.E11.1.454.light.4.raw

SEQ ID NO: 551725 - DNA, 488 bp, Homo sapiens; identical to SEQ ID NO: 536861
  misc_feature: HIJSMM301BIMRX.12.88.H11.1.454.light.4.raw

SEQ ID NO: 551726 - DNA, 483 bp, Homo sapiens
  misc_feature: HIJSMM301BMDB8.52.4.A04.1.454.light.4.raw
cgcagtacgacacgaccggtgctcgatttagagtagtgatcagggggggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcaggcccaaggctgccccctcggt

SEQ ID NO: 551727 - DNA, 499 bp, Homo sapiens
  misc_feature: HIJSMM301BA855.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggcttcaccatctgtcttcatt

SEQ ID NO: 551728 - DNA, 416 bp, Homo sapiens; identical to SEQ ID NO: 536892
  misc_feature: HIJSMM301EK7P8.16.46.E02.1.454.light.4.raw

SEQ ID NO: 551729 - DNA, 534 bp, Homo sapiens
  misc_feature: HIJSMM301AYTKZ.43.81.H04.1.454.light.4.raw
tgtgagtagtcacgaccggtgctcgatttagtagtgtagattcgcggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgtaccgtcctacggtcgagcccaacggcgtcgcccccgtcccggtcgactcttcgttcccggtcccctccttccacta

SEQ ID NO: 551730 - DNA, 494 bp, Homo sapiens
  misc_feature: HIJSMM301C02HJ.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacacttgacaatcaacagagtggaggctgaggatgttggggtttattactgcgtgcaaagtctgcaaactatcaccttcggccaagggacacgactggagattaaacgaactgtggctgcacc

SEQ ID NO: 551731 - DNA, 479 bp, Homo sapiens; identical to SEQ ID NO: 537141
  misc_feature: HIJSMM301AY6DU.7.76.G10.1.454.light.4.raw

SEQ ID NO: 551732 - DNA, 487 bp, Homo sapiens; identical to SEQ ID NO: 536025
  misc_feature: HIJSMM301BFUF9.17.34.D01.1.454.light.4.raw

SEQ ID NO: 551733 - DNA, 353 bp, Homo sapiens; identical to SEQ ID NO: 536338
  misc_feature: HIJSMM301DL7NH.3.11.A11.1.454.light.4.raw

SEQ ID NO: 551734 - DNA, 494 bp, Homo sapiens; identical to SEQ ID NO: 535680
  misc_feature: HIJSMM301A7XZ8.16.78.H01.1.454.light.4.raw

SEQ ID NO: 551735 - DNA, 497 bp, Homo sapiens
  misc_feature: HIJSMM301EJ0K7.51.55.E11.1.454.light.4.raw
cgatcgtatacacgaccggtgctcgatttagcactcgcacgttgggtttgggggccgtcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgtt

SEQ ID NO: 551736 - DNA, 382 bp, Homo sapiens
  misc_feature: HIJSMM301D4S2M.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatcgaatagtataga

SEQ ID NO: 551737 - DNA, 480 bp, Homo sapiens
  misc_feature: HIJSMM301DBXLH.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcgcgggacc

SEQ ID NO: 551738 - DNA, 506 bp, Homo sapiens
  misc_feature: HIJSMM301C3Y6M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaacgaactacgtggctgcaccatctgtcttctatcttccccg

SEQ ID NO: 551739 - DNA, 486 bp, Homo sapiens; identical to SEQ ID NO: 535523
  misc_feature: HIJSMM301BKMIN.22.73.G07.1.454.light.4.raw

SEQ ID NO: 551740 - DNA, 505 bp, Homo sapiens
  misc_feature: HIJSMM301C3DUM.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgacccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 551741 - DNA, 510 bp, Homo sapiens
  misc_feature: HIJSMM301B7BNS.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgcc

SEQ ID NO: 551742 - DNA, 497 bp, Homo sapiens
  misc_feature: HIJSMM301D7QYP.3.79.H02.1.454.light.4.raw
agacgcactccacgaccggtgctcgatttagtgtcacacgaagggaaagggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctc

SEQ ID NO: 551743 - DNA, 409 bp, Homo sapiens
  misc_feature: HIJSMM301DYPC2.10.86.H09.1.454.light.4.raw
catagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccaccctcctccactactatg

SEQ ID NO: 551744 - DNA, 505 bp, Homo sapiens; identical to SEQ ID NO: 535503
  misc_feature: HIJSMM301A5W7Y.8.28.C06.1.454.light.4.raw

SEQ ID NO: 551745 - DNA, 497 bp, Homo sapiens
  misc_feature: HIJSMM301C90EH.40.23.C01.1.454.light.4.raw
  modified_base (475)..(475): a, c, t, g, unknown or other
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctggggacagacttcactctcaccatcagcggcctagagcctgaagactttgcagtttattactgtcagcagcgtaccaactggccgctcactttcggcggagggaccaaggtggagatcaaacgaaactntggctgcaccatctgtcttcat

SEQ ID NO: 551746 - DNA, 497 bp, Homo sapiens
  misc_feature: HIJSMM301BEVF0.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttaccgccat

SEQ ID NO: 551747 - DNA, 510 bp, Homo sapiens
  misc_feature: HIJSMM301C6PNZ.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatacaaacgaactagtggctgcaccactctgtctt

SEQ ID NO: 551748 - DNA, 493 bp, Homo sapiens; identical to SEQ ID NO: 535084
  misc_feature: HIJSMM301C5KXN.47.64.F09.1.454.light.4.raw

SEQ ID NO: 551749 - DNA, 460 bp, Homo sapiens; identical to SEQ ID NO: 540069
  misc_feature: HIJSMM301BLTXD.11.86.H09.1.454.light.4.raw

SEQ ID NO: 551750 - DNA, 447 bp, Homo sapiens; identical to SEQ ID NO: 535020
  misc_feature: HIJSMM301CFF3L.18.9.A09.1.454.light.4.raw

SEQ ID NO: 551751 - DNA, 497 bp, Homo sapiens; identical to SEQ ID NO: 536376
  misc_feature: HIJSMM301AL81R.22.9.A09.1.454.light.4.raw

SEQ ID NO: 551752 - DNA, 494 bp, Homo sapiens
  misc_feature: HIJSMM301DC3IJ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgactcactttcggcggagggaccagggtggagatcaaacgaactgtggctgcaccatctgtcttcatt

SEQ ID NO: 551753 - DNA, 493 bp, Homo sapiens
  misc_feature: HIJSMM301EIKPZ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcacccagtctttgtctccaggggaaagagccaccctctcctgcagggccagtcactatgttagtgataactacttagcctggttgcagcacaaacctggccaggctcccaggctcctcatctatgctgtatccatcagggccactggcatcccaggcagattcagtggcagtgggtcggggacagacttcactctcaccatcagcagactggagcctgaagattttgcagtctattactgtcagcagtatggtcacgtcccaagaacttttggccaggggaccaagctggagatcaaacgaactgtggctgcaccatctgtctt

SEQ ID NO: 551754 - DNA, 483 bp, Homo sapiens; identical to SEQ ID NO: 538076
  misc_feature: HIJSMM301CT2Q6.14.53.E09.1.454.light.4.raw

SEQ ID NO: 551755 - DNA, 484 bp, Homo sapiens; identical to SEQ ID NO: 535400
  misc_feature: HIJSMM301AI6XP.46.26.C04.1.454.light.4.raw

SEQ ID NO: 551756 - DNA, 489 bp, Homo sapiens
  misc_feature: HIJSMM301BJL07.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcc

SEQ ID NO: 551757 - DNA, 383 bp, Homo sapiens
  misc_feature: HIJSMM301DYWSP.48.55.E11.1.454.light.4.raw
agtatacatacacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 551758 - DNA, 513 bp, Homo sapiens
  misc_feature: HIJSMM301AVTNW.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 551759 - DNA, 494 bp, Homo sapiens; identical to SEQ ID NO: 534994
  misc_feature: HIJSMM301BK6PS.27.78.H01.1.454.light.4.raw

SEQ ID NO: 551760 - DNA, 485 bp, Homo sapiens; identical to SEQ ID NO: 536576
  misc_feature: HIJSMM301AHYGD.46.35.D02.1.454.light.4.raw

SEQ ID NO: 551761 - DNA, 496 bp, Homo sapiens
  misc_feature: HIJSMM301CFQRY.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactcc

SEQ ID NO: 551762 - DNA, 493 bp, Homo sapiens; identical to SEQ ID NO: 540903
  misc_feature: HIJSMM301A3PE6.10.20.B09.1.454.light.4.raw

SEQ ID NO: 551763 - DNA, 506 bp, Homo sapiens
  misc_feature: HIJSMM301AZC21.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaatacaaacgaactagtggctgcaccatctgtcttcatcttccccg

SEQ ID NO: 551764 - DNA, 477 bp, Homo sapiens
  misc_feature: HIJSMM301DUNJQ.41.76.G10.1.454.light.4.raw
tctatactatcacgaccggtgctcgatttagtcactcatacagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgttcggccaagggaccaaggtggacatcaaacgaactgtggctgcaccta

SEQ ID NO: 551765 - DNA, 521 bp, Homo sapiens; identical to SEQ ID NO: 539470
  misc_feature: HIJSMM301DKNAY.27.23.C01.1.454.light.4.raw

SEQ ID NO: 551766 - DNA, 447 bp, Homo sapiens; identical to SEQ ID NO: 535201
  misc_feature: HIJSMM301CVYZO.18.9.A09.1.454.light.4.raw

SEQ ID NO: 551767 - DNA, 480 bp, Homo sapiens
  misc_feature: HIJSMM301BZ2DV.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcacat

SEQ ID NO: 551768 - DNA, 485 bp, Homo sapiens; identical to SEQ ID NO: 536576
  misc_feature: HIJSMM301CR2TB.46.35.D02.1.454.light.4.raw

SEQ ID NO: 551769 - DNA, 499 bp, Homo sapiens
  misc_feature: HIJSMM301BKHH9.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 551770 - DNA, 494 bp, Homo sapiens
  misc_feature: HIJSMM301ER18L.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaagggaccaaggtggataatcagaccgaaa

SEQ ID NO: 551771 - DNA, 483 bp, Homo sapiens
  misc_feature: HIJSMM301A6HZ7.11.67.G01.1.454.light.4.raw
  modified_base (205)..(205): a, c, t, g, unknown or other
  modified_base (432)..(432): a, c, t, g, unknown or other
  modified_base (444)..(444): a, c, t, g, unknown or other
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctggggacccccgggnagagaatcaccatctcttgtactggaagcagctccaatatcggaagtaacgatgtcaattggtatcaacatctccccggtacggcccccaaactcctcatctataggaatagccagcggccctcgacggggtccctggccgattctctggctcgaagtctggcacctcagcctccctggcctgcagtggctccagtctgaggatgaggctgactattattgtgcagngtggatgacgtntgagtgctgtggtctcggcggaggaccaagctgaccgtc

SEQ ID NO: 551772 - DNA, 500 bp, Homo sapiens
  misc_feature: HIJSMM301AWT1S.43.33.C11.1.454.light.4.raw
tgtgagtagtcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggtccaagggaccgaacgtggaaatacaaacgaactagtggctgcaccatctgtcttctatt

SEQ ID NO: 551773 - DNA, 487 bp, Homo sapiens; identical to SEQ ID NO: 537573
  misc_feature: HIJSMM301ANO58.3.10.A10.1.454.light.4.raw

SEQ ID NO: 551774 - DNA, 486 bp, Homo sapiens; identical to SEQ ID NO: 536261
  misc_feature: HIJSMM301DSR1Z.26.55.E11.1.454.light.4.raw

SEQ ID NO: 551775 - DNA, 484 bp, Homo sapiens
  misc_feature: HIJSMM301B98X7.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcgaccaagggacacgactggagattaaacgaactgtggctgcaccat

SEQ ID NO: 551776 - DNA, 514 bp, Homo sapiens
  misc_feature: HIJSMM301B07UJ.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcggagtcgctaggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctca

SEQ ID NO: 551777 - DNA, 504 bp, Homo sapiens; identical to SEQ ID NO: 538423
  misc_feature: HIJSMM301C2EUG.48.67.G01.1.454.light.4.raw

SEQ ID NO: 551778 - DNA, 472 bp, Homo sapiens
  misc_feature: HIJSMM301AYGV7.52.1.A01.1.454.light.4.raw
cgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaaggttcagtggcagtggatctgggacagaattcactctcaccatcaccagtctgcaggctgaggattttgcaacttacttctgtcaacagagttacagttccctcactttcggccctgggaccatagtggatatcaacgaactgtggctgcaccatctgtcttcatcttcccgcat

SEQ ID NO: 551779 - DNA, 490 bp, Homo sapiens
  misc_feature: HIJSMM301BV1PE.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtaatcctccgaggctcactttcggcggagggaccaaggtggagatcaaacgaa

SEQ ID NO: 551780 - DNA, 485 bp, Homo sapiens
  misc_feature: HIJSMM301DW0R9.40.36.D03.1.454.light.4.raw
tctagcgactcacgaccggtgctcgatttagctgcgtcacgatctctcttggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattatattattccgaggacgttcggccaagggaccaaggtggaaatcaaacgaa

SEQ ID NO: 551781 - DNA, 493 bp, Homo sapiens
  misc_feature: HIJSMM301D57MF.9.1.A01.1.454.light.4.raw
tgatacgtctcacgaccggtgctcgatttagacgtctcatcagggggagctgctcagttaggacccagagggaaccatggaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 551782 - DNA, 460 bp, Homo sapiens; identical to SEQ ID NO: 539553
  misc_feature: HIJSMM301AFL9K.11.86.H09.1.454.light.4.raw

SEQ ID NO: 551783 - DNA, 503 bp, Homo sapiens
  misc_feature: HIJSMM301A8RUP.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcgggcggagggaccaagctgaccgtcctcggtcacgcccaaggct

SEQ ID NO: 551784 - DNA, 517 bp, Homo sapiens; identical to SEQ ID NO: 536262
  misc_feature: HIJSMM301BRG5X.14.70.G04.1.454.light.4.raw

SEQ ID NO: 551785 - DNA, 498 bp, Homo sapiens
  misc_feature: HIJSMM301DZXN3.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctccttcagacgttcggccaagggaccaaggtggaaatcaaacgaactgtggctgcacca

SEQ ID NO: 551786 - DNA, 496 bp, Homo sapiens; identical to SEQ ID NO: 535109
  misc_feature: HIJSMM301DR1WX.16.78.H01.1.454.light.4.raw

SEQ ID NO: 551787 - DNA, 479 bp, Homo sapiens; identical to SEQ ID NO: 535586
  misc_feature: HIJSMM301CUYD4.13.34.D01.1.454.light.4.raw

SEQ ID NO: 551788 - DNA, 504 bp, Homo sapiens
  misc_feature: HIJSMM301EA3I9.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccgccctcctctacgtcgtat

SEQ ID NO: 551789 - DNA, 490 bp, Homo sapiens
  misc_feature: HIJSMM301ANJNC.52.3.A03.1.454.light.4.raw
cgcagtacgacacgaccggtgctcgatttagagagcgtcacagggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataactagtttttcattcacttttggcccctgggacgacagtggatatcaaacgaactgtggctgcaccatctgttcttcta

SEQ ID NO: 551790 - DNA, 460 bp, Homo sapiens; identical to SEQ ID NO: 536053
  misc_feature: HIJSMM301B5RY5.22.28.C06.1.454.light.4.raw

SEQ ID NO: 551791 - DNA, 510 bp, Homo sapiens; identical to SEQ ID NO: 535855
  misc_feature: HIJSMM301AH4N4.17.33.C11.1.454.light.4.raw

SEQ ID NO: 551792 - DNA, 454 bp, Homo sapiens
  misc_feature: HIJSMM301BNAOA.19.86.H09.1.454.light.4.raw
  modified_base (113)..(113): a, c, t, g, unknown or other
tactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 551793 - DNA, 506 bp, Homo sapiens
  misc_feature: HIJSMM301A0HCN.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctggaccaaagtggatatcaacgaactgtggctgcaccatctgtcttcta

SEQ ID NO: 551794 - DNA, 496 bp, Homo sapiens
  misc_feature: HIJSMM301ENKFN.43.33.C11.1.454.light.4.raw
tgtgagtagtcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaactagtggctgcaccatctgtcttcatt

SEQ ID NO: 551795 - DNA, 508 bp, Homo sapiens
  misc_feature: HIJSMM301EBI2T.52.60.F05.1.454.light.4.raw
cgcagtacgacacgaccggtgctcgatttagtacgtcatcagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaatacccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtcact

SEQ ID NO: 551796 - DNA, 494 bp, Homo sapiens
  misc_feature: HIJSMM301C7OJN.13.5.A05.1.454.light.4.raw
tcacgtactacacgaccggtgctcgatttagatagatagacgggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagta

SEQ ID NO: 551797 - DNA, 495 bp, Homo sapiens
  misc_feature: HIJSMM301ENMCV.11.71.G05.1.454.light.4.raw
cgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaacgaactgtggctgcaccatctgtcttcatcttcccg

SEQ ID NO: 551798 - DNA, 492 bp, Homo sapiens
  misc_feature: HIJSMM301CJE47.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgactgtggctgcaccatctgtcttcatcttcccg

SEQ ID NO: 551799 - DNA, 521 bp, Homo sapiens
  misc_feature: HIJSMM301DRTNE.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctcgccccctcggtcactctcgttcccgccctccctacg

SEQ ID NO: 551800 - DNA, 465 bp, Homo sapiens
  misc_feature: HIJSMM301A91AQ.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccgaagctgaccgtcctaggtcagcccaacggcgtgccccctccggtcactctgttcccaccctcctccgtatctctcg

SEQ ID NO: 551801 - DNA, 498 bp, Homo sapiens
  misc_feature: HIJSMM301EN8NS.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatactcggcggagggaccaaggtgaccgtcctacgtcagcccaaggctcgccccctcggtcactctcg

SEQ ID NO: 551802 - DNA, 480 bp, Homo sapiens
  misc_feature: HIJSMM301A9PKO.21.87.H10.1.454.light.4.raw
tcgtcgctcgcacgaccggtgctcgatttagcagtactgcgttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggacc

SEQ ID NO: 551803 - DNA, 484 bp, Homo sapiens; identical to SEQ ID NO: 551470
  misc_feature: HIJSMM301CE9MT.10.1.A01.1.454.light.4.raw

SEQ ID NO: 551804 - DNA, 505 bp, Homo sapiens; identical to SEQ ID NO: 536117
  misc_feature: HIJSMM301B9U2T.8.71.G05.1.454.light.4.raw

SEQ ID NO: 551805 - DNA, 416 bp, Homo sapiens; identical to SEQ ID NO: 536892
  misc_feature: HIJSMM301DE0FQ.16.46.E02.1.454.light.4.raw

SEQ ID NO: 551806 - DNA, 503 bp, Homo sapiens; identical to SEQ ID NO: 542867
  misc_feature: HIJSMM301AUE70.14.57.F02.1.454.light.4.raw

SEQ ID NO: 551807 - DNA, 507 bp, Homo sapiens
  misc_feature: HIJSMM301DOR5P.22.21.B10.1.454.light.4.raw
acatacgcgtcacgaccggtgctcgatttagtgtcgtcgcaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctcgccccctcggtcacctctcg

SEQ ID NO: 551808 - DNA, 518 bp, Homo sapiens; identical to SEQ ID NO: 544387
  misc_feature: HIJSMM301DCNXG.19.80.H03.1.454.light.4.raw

SEQ ID NO: 551809 - DNA, 509 bp, Homo sapiens
  misc_feature: HIJSMM301ADPRU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaaggtggaaggtcaagcgaactgtggctgcaccatctgtcttcatcttcccgcc

SEQ ID NO: 551810 - DNA, 494 bp, Homo sapiens; identical to SEQ ID NO: 534994
  misc_feature: HIJSMM301AOYRG.27.78.H01.1.454.light.4.raw

SEQ ID NO: 551811 - DNA, 496 bp, Homo sapiens; identical to SEQ ID NO: 536690
  misc_feature: HIJSMM301AR88P.40.23.C01.1.454.light.4.raw

SEQ ID NO: 551812 - DNA, 459 bp, Homo sapiens
  misc_feature: HIJSMM301AYM4B.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttccgccctcctcgtatctctcg

SEQ ID NO: 551813 - DNA, 493 bp, Homo sapiens; identical to SEQ ID NO: 539015
  misc_feature: HIJSMM301CU9QF.27.78.H01.1.454.light.4.raw

SEQ ID NO: 551814 - DNA, 484 bp, Homo sapiens
  misc_feature: HIJSMM301DZU9E.40.83.H06.1.454.light.4.raw
tctagcgactcacgaccggtgctcgatttagatcacgtgcgtcgcagggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacgg

SEQ ID NO: 551815 - DNA, 510 bp, Homo sapiens
  misc_feature: HIJSMM301CUW4Q.43.5.A05.1.454.light.4.raw
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttggggcaaagctgccctgaccctttcgggtgcgcagcctgaggatgaggctgactattactgcttgctcgcctatgatgctgctcgggttttcgcggagggaccaagttgaccgtcctaggtcagcccaaggctgccccctcggtcactctgttcccgccctcctca

SEQ ID NO: 551816 - DNA, 505 bp, Homo sapiens
  misc_feature: HIJSMM301BF020.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 551817 - DNA, 513 bp, Homo sapiens; identical to SEQ ID NO: 535244
  misc_feature: HIJSMM301BJ3MJ.17.33.C11.1.454.light.4.raw

SEQ ID NO: 551818 - DNA, 486 bp, Homo sapiens
  misc_feature: HIJSMM301DF2OJ.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtggagatcaaacgaactgtggctgcaccatctgtt

SEQ ID NO: 551819 - DNA, 496 bp, Homo sapiens; identical to SEQ ID NO: 535597
  misc_feature: HIJSMM301EDXW6.22.20.B09.1.454.light.4.raw

SEQ ID NO: 551820 - DNA, 480 bp, Homo sapiens
  misc_feature: HIJSMM301CG6VB.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtctttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtctaggtcagcccaaggctgccccccg

SEQ ID NO: 551821 - DNA, 485 bp, Homo sapiens; identical to SEQ ID NO: 535985
  misc_feature: HIJSMM301EPBE2.15.1.A01.1.454.light.4.raw

SEQ ID NO: 551822 - DNA, 416 bp, Homo sapiens
  misc_feature: HIJSMM301AHE4F.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 551823 - DNA, 522 bp, Homo sapiens; identical to SEQ ID NO: 541090
  misc_feature: HIJSMM301ASFDU.27.23.C01.1.454.light.4.raw

SEQ ID NO: 551824 - DNA, 487 bp, Homo sapiens; identical to SEQ ID NO: 536206
  misc_feature: HIJSMM301CCBWB.47.38.D05.1.454.light.4.raw

SEQ ID NO: 551825 - DNA, 464 bp, Homo sapiens
  misc_feature: HIJSMM301BKYT0.26.78.H01.1.454.light.4.raw
agactatactcacgaccggtgctcgatttagtgtgagtagtttgggtttgggggagggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttccgccatctgaagtatagtct

SEQ ID NO: 551826 - DNA, 489 bp, Homo sapiens; identical to SEQ ID NO: 535139
  misc_feature: HIJSMM301ALNFG.14.55.E11.1.454.light.4.raw

SEQ ID NO: 551827 - DNA, 502 bp, Homo sapiens
  misc_feature: HIJSMM301A1KSF.13.11.A11.1.454.light.4.raw
tcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactcttcg

SEQ ID NO: 551828 - DNA, 502 bp, Homo sapiens
  misc_feature: HIJSMM301C5M14.43.86.H09.1.454.light.4.raw
tgtgagtagtcacgaccggtgctcgatttagtgctatagacttgggtttggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatct

SEQ ID NO: 551829 - DNA, 513 bp, Homo sapiens
  misc_feature: HIJSMM301BVKCH.52.20.B09.1.454.light.4.raw
cgcagtacgacacgaccggtgctcgatttagtgtagtgtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaagcccccaaactcatgatttatgatatcagtgatcggccctcaggggtttcgaatcgcttctctggctccaagtccggcaacacggcctccctgaccatctctgggctccaggccgaggacgaggctgattattattgcagctcatatacaaacaacaacaattgggtgttcggcggagggaccaagctgaccgtcctaggtcagcccaaggctgccccctcggtcactctgttcccg

SEQ ID NO: 551830 - DNA, 479 bp, Homo sapiens
  misc_feature: HIJSMM301BDA7X.5.70.G04.1.454.light.4.raw
  modified_base (229)..(229): a, c, t, g, unknown or other
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtnttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagtatttgctaacttacttttgtctaacaggctcagtagtttcccgctcactttcggcggtagggaccaaggtggagatcaaacgaactgtgg

SEQ ID NO: 551831 - DNA, 486 bp, Homo sapiens; identical to SEQ ID NO: 535385
  misc_feature: HIJSMM301C9NBQ.19.71.G05.1.454.light.4.raw

SEQ ID NO: 551832 - DNA, 482 bp, Homo sapiens; identical to SEQ ID NO: 538815
  misc_feature: HIJSMM301ADUCC.4.34.D01.1.454.light.4.raw

SEQ ID NO: 551833 - DNA, 447 bp, Homo sapiens; identical to SEQ ID NO: 535201
  misc_feature: HIJSMM301BFCDJ.18.9.A09.1.454.light.4.raw

SEQ ID NO: 551834 - DNA, 486 bp, Homo sapiens; identical to SEQ ID NO: 535385
  misc_feature: HIJSMM301DOCAC.19.71.G05.1.454.light.4.raw

SEQ ID NO: 551835 - DNA, 497 bp, Homo sapiens; identical to SEQ ID NO: 536376
  misc_feature: HIJSMM301CGZQ8.22.9.A09.1.454.light.4.raw

SEQ ID NO: 551836 - DNA, 483 bp, Homo sapiens
  misc_feature: HIJSMM301BZNN4.49.53.E09.1.454.light.4.raw
agtcgagagacacgaccggtgctcgatttagagagagtgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagacaaaagccaggacagcctcctgaactgctcatttactggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggaggaccagggtggagatcaaacg

SEQ ID NO: 551837 - DNA, 497 bp, Homo sapiens; identical to SEQ ID NO: 535286
  misc_feature: HIJSMM301BVJNO.18.59.F04.1.454.light.4.raw

SEQ ID NO: 551838 - DNA, 488 bp, Homo sapiens; identical to SEQ ID NO: 540389
  misc_feature: HIJSMM301A7N42.9.75.G09.1.454.light.4.raw

SEQ ID NO: 551839 - DNA, 488 bp, Homo sapiens
  misc_feature: HIJSMM301B7BXW.51.73.G07.1.454.light.4.raw
cgatcgtatacacgaccggtgctcgatttagctctacgctcagggcacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgaccg

SEQ ID NO: 551840 - DNA, 460 bp, Homo sapiens; identical to SEQ ID NO: 536053
  misc_feature: HIJSMM301A8C42.22.28.C06.1.454.light.4.raw

SEQ ID NO: 551841 - DNA, 444 bp, Homo sapiens; identical to SEQ ID NO: 537971
  misc_feature: HIJSMM301EHALP.2.76.G10.1.454.light.4.raw

SEQ ID NO: 551842 - DNA, 493 bp, Homo sapiens; identical to SEQ ID NO: 535381
  misc_feature: HIJSMM301AVPTO.13.39.D06.1.454.light.4.raw

SEQ ID NO: 551843 - DNA, 513 bp, Homo sapiens
  misc_feature: HIJSMM301COBCW.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcgctacg

SEQ ID NO: 551844 - DNA, 490 bp, Homo sapiens
  misc_feature: HIJSMM301C1HJ7.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggagatacaaacgaa

SEQ ID NO: 551845 - DNA, 445 bp, Homo sapiens
  misc_feature: HIJSMM301DP082.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttccccaccctcctccgtgtctgat

SEQ ID NO: 551846 - DNA, 445 bp, Homo sapiens
  misc_feature: HIJSMM301A0X3Z.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccaccctcctcgtactagacg

SEQ ID NO: 551847 - DNA, 503 bp, Homo sapiens
  misc_feature: HIJSMM301BMLRK.27.78.H01.1.454.light.4.raw
  modified_base (495)..(495): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacg

SEQ ID NO: 551848 - DNA, 506 bp, Homo sapiens
  misc_feature: HIJSMM301EEJT0.40.35.D02.1.454.light.4.raw
tctagcgactcacgaccggtgctcgatttagcacacgatagttgggtttgggggaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatcttcccg

SEQ ID NO: 551849 - DNA, 485 bp, Homo sapiens
  misc_feature: HIJSMM301CA5JN.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccgaagactgaccggtcctaacgtacagcccaac

SEQ ID NO: 551850 - DNA, 486 bp, Homo sapiens; identical to SEQ ID NO: 535290
  misc_feature: HIJSMM301AK5L9.3.12.B01.1.454.light.4.raw

SEQ ID NO: 551851 - DNA, 466 bp, Homo sapiens; identical to SEQ ID NO: 535366
  misc_feature: HIJSMM301BW1B1.13.4.A04.1.454.light.4.raw

SEQ ID NO: 551852 - DNA, 494 bp, Homo sapiens; identical to SEQ ID NO: 534992
  misc_feature: HIJSMM301DZUAO.9.1.A01.1.454.light.4.raw

SEQ ID NO: 551853 - DNA, 508 bp, Homo sapiens
  misc_feature: HIJSMM301ENT9S.17.87.H10.1.454.light.4.raw
cgtagactagcacgaccggtgctcgatttagcagtactgcgttgggtttggggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtca

SEQ ID NO: 551854 - DNA, 515 bp, Homo sapiens; identical to SEQ ID NO: 547905
  misc_feature: HIJSMM301BLK3I.8.23.C01.1.454.light.4.raw

SEQ ID NO: 551855 - DNA, 475 bp, Homo sapiens; identical to SEQ ID NO: 537714
  misc_feature: HIJSMM301AL9TZ.7.81.H04.1.454.light.4.raw

SEQ ID NO: 551856 - DNA, 488 bp, Homo sapiens
  misc_feature: HIJSMM301A5CQQ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgcggctgcacca

SEQ ID NO: 551857 - DNA, 523 bp, Homo sapiens
  misc_feature: HIJSMM301BN6GM.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactcgtcactctcgttcccaccctccctccgtgt

SEQ ID NO: 551858 - DNA, 506 bp, Homo sapiens; identical to SEQ ID NO: 546231
  misc_feature: HIJSMM301CJBXE.8.71.G05.1.454.light.4.raw

SEQ ID NO: 551859 - DNA, 477 bp, Homo sapiens; identical to SEQ ID NO: 536960
  misc_feature: HIJSMM301D48DY.52.1.A01.1.454.light.4.raw

SEQ ID NO: 551860 - DNA, 491 bp, Homo sapiens; identical to SEQ ID NO: 535194
  misc_feature: HIJSMM301EDFA1.26.78.H01.1.454.light.4.raw

SEQ ID NO: 551861 - DNA, 525 bp, Homo sapiens
  misc_feature: HIJSMM301EWGAP.49.71.G05.1.454.light.4.raw
agtcgagagacacgaccggtgctcgatttagtgtcgtcgcaagagagaggggggtctcaggaggcagcgctcgcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattttgtctcctggtaccaacaccacccagacaaagcccccagactcattatttatggtgtcggtgaccggccctcagggtttcgaatcgcttctctggctccaagtccggctgcacggcctccctgaccctctctgggctccaggccgaggacgaggctgattattactgcgcctcatatacaaacaacaacatttgggtgtttcggcggagggaccaagctgaccgtcctaggtcagcccaaggctgccccctcggtcactctgttcccgccctcctctct

SEQ ID NO: 551862 - DNA, 510 bp, Homo sapiens
  misc_feature: HIJSMM301ENF10.51.35.D02.1.454.light.4.raw
cgatcgtatacacgaccggtgctcgatttagcacacgatagttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctcg

SEQ ID NO: 551863 - DNA, 485 bp, Homo sapiens; identical to SEQ ID NO: 536040
  misc_feature: HIJSMM301CW8CA.15.1.A01.1.454.light.4.raw

SEQ ID NO: 551864 - DNA, 487 bp, Homo sapiens; identical to SEQ ID NO: 535583
  misc_feature: HIJSMM301DAZ8U.22.73.G07.1.454.light.4.raw

SEQ ID NO: 551865 - DNA, 494 bp, Homo sapiens; identical to SEQ ID NO: 534994
  misc_feature: HIJSMM301AD2NZ.27.78.H01.1.454.light.4.raw

SEQ ID NO: 551866 - DNA, 494 bp, Homo sapiens; identical to SEQ ID NO: 535629
  misc_feature: HIJSMM301AN8E8.4.27.C05.1.454.light.4.raw

SEQ ID NO: 551867 - DNA, 513 bp, Homo sapiens
  misc_feature: HIJSMM301DXXMN.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcct

SEQ ID NO: 551868 - DNA, 499 bp, Homo sapiens
  misc_feature: HIJSMM301EHJDF.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagttatttttgtcagcaatattatcatactccgctcactttcggcggagggaccaaggtggagatcaaacgaactgtggctgcacca

SEQ ID NO: 551869 - DNA, 486 bp, Homo sapiens; identical to SEQ ID NO: 535385
  misc_feature: HIJSMM301B1SHI.19.71.G05.1.454.light.4.raw

SEQ ID NO: 551870 - DNA, 441 bp, Homo sapiens; identical to SEQ ID NO: 534971
  misc_feature: HIJSMM301D4ZBG.11.3.A03.1.454.light.4.raw

SEQ ID NO: 551871 - DNA, 487 bp, Homo sapiens; identical to SEQ ID NO: 536206
  misc_feature: HIJSMM301EB1OL.47.38.D05.1.454.light.4.raw

SEQ ID NO: 551872 - DNA, 455 bp, Homo sapiens; identical to SEQ ID NO: 542772
  misc_feature: HIJSMM301B1DZP.19.86.H09.1.454.light.4.raw

SEQ ID NO: 551873 - DNA, 499 bp, Homo sapiens; identical to SEQ ID NO: 540144
  misc_feature: HIJSMM301AG4V0.47.66.F11.1.454.light.4.raw

SEQ ID NO: 551874 - DNA, 493 bp, Homo sapiens
  misc_feature: HIJSMM301B6M05.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatccttcccgccat

SEQ ID NO: 551875 - DNA, 473 bp, Homo sapiens
  misc_feature: HIJSMM301CNST6.3.38.D05.1.454.light.4.raw
agacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatacaacgaaa

SEQ ID NO: 551876 - DNA, 490 bp, Homo sapiens; identical to SEQ ID NO: 541974
  misc_feature: HIJSMM301BJSZF.22.65.F10.1.454.light.4.raw

SEQ ID NO: 551877 - DNA, 494 bp, Homo sapiens; identical to SEQ ID NO: 535629
  misc_feature: HIJSMM301BSVOZ.4.27.C05.1.454.light.4.raw

SEQ ID NO: 551878 - DNA, 486 bp, Homo sapiens; identical to SEQ ID NO: 536323
  misc_feature: HIJSMM301DD57C.10.2.A02.1.454.light.4.raw

SEQ ID NO: 551879 - DNA, 481 bp, Homo sapiens
  misc_feature: HIJSMM301CLTNS.49.57.F02.1.454.light.4.raw
agtcgagagacacgaccggtgctcgatttagctcgatatagttgggtttggggacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaa

SEQ ID NO: 551880 - DNA, 473 bp, Homo sapiens; identical to SEQ ID NO: 535262
  misc_feature: HIJSMM301EKLSZ.8.67.G01.1.454.light.4.raw

SEQ ID NO: 551881 - DNA, 487 bp, Homo sapiens; identical to SEQ ID NO: 538190
  misc_feature: HIJSMM301CR48X.47.70.G04.1.454.light.4.raw

SEQ ID NO: 551882 - DNA, 490 bp, Homo sapiens; identical to SEQ ID NO: 535526
  misc_feature: HIJSMM301BK8AJ.26.78.H01.1.454.light.4.raw

SEQ ID NO: 551883 - DNA, 486 bp, Homo sapiens
  misc_feature: HIJSMM301A417F.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacactttggccaggggaccaaactggacatcaaacgaactgtggctgcaccatctgt

SEQ ID NO: 551884 - DNA, 489 bp, Homo sapiens; identical to SEQ ID NO: 535139
  misc_feature: HIJSMM301B3I9I.14.55.E11.1.454.light.4.raw

SEQ ID NO: 551885 - DNA, 466 bp, Homo sapiens
  misc_feature: HIJSMM301BUNQY.43.75.G09.1.454.light.4.raw
tgtgagtagtcacgaccggtgctcgatttagtatagacatcagggggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccaggggaccaagctggagatcaatcgaactgt

SEQ ID NO: 551886 - DNA, 494 bp, Homo sapiens; identical to SEQ ID NO: 534992
  misc_feature: HIJSMM301CP07F.9.1.A01.1.454.light.4.raw

SEQ ID NO: 551887 - DNA, 485 bp, Homo sapiens; identical to SEQ ID NO: 535606
  misc_feature: HIJSMM301EJH1N.47.46.E02.1.454.light.4.raw

SEQ ID NO: 551888 - DNA, 521 bp, Homo sapiens; identical to SEQ ID NO: 539470
  misc_feature: HIJSMM301DGU13.27.23.C01.1.454.light.4.raw

SEQ ID NO: 551889 - DNA, 479 bp, Homo sapiens; identical to SEQ ID NO: 535531
  misc_feature: HIJSMM301DZFJO.41.17.B06.1.454.light.4.raw

SEQ ID NO: 551890 - DNA, 506 bp, Homo sapiens
  misc_feature: HIJSMM301DIG4K.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattatctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccgaccctccc

SEQ ID NO: 551891 - DNA, 485 bp, Homo sapiens; identical to SEQ ID NO: 546308
  misc_feature: HIJSMM301D6O23.47.60.F05.1.454.light.4.raw

SEQ ID NO: 551892 - DNA, 497 bp, Homo sapiens
  misc_feature: HIJSMM301CWSK8.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttcctaatcgcttctctggctccaagtctggcgacacggcctccctgaccatctctgggctccaggctgaagacgaggctgattattacttgcagctcatatacaggcagcagcactcaggttttcggcggagggaccaagctgaccgtcctagtcagcccaaggctgccccctcggt

SEQ ID NO: 551893 - DNA, 508 bp, Homo sapiens
  misc_feature: HIJSMM301AMH8A.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaacggaccgaacggtaggaatacaagacgaactagtggctgcaccatctgtcttctatcttccgt

SEQ ID NO: 551894 - DNA, 494 bp, Homo sapiens
  misc_feature: HIJSMM301A6JGU.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctacttcttttctcttcggaactgggaccacggtcaccgtctaggtcagcccaaggccaaccca

SEQ ID NO: 551895 - DNA, 492 bp, Homo sapiens; identical to SEQ ID NO: 541945
  misc_feature: HIJSMM301AWDHM.49.67.G01.1.454.light.4.raw

SEQ ID NO: 551896 - DNA, 486 bp, Homo sapiens
  misc_feature: HIJSMM301CYVTM.51.55.E11.1.454.light.4.raw
cgatcgtatacacgaccggtgctcgatttagcactcgcacgttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaacgaactgtggctgcac

SEQ ID NO: 551897 - DNA, 487 bp, Homo sapiens; identical to SEQ ID NO: 537009
  misc_feature: HIJSMM301AVMIY.12.88.H11.1.454.light.4.raw

SEQ ID NO: 551898 - DNA, 475 bp, Homo sapiens
  misc_feature: HIJSMM301BFG90.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgcccctccactactcgtactagtgcgggccggtggcgacggacggcc

SEQ ID NO: 551899 - DNA, 491 bp, Homo sapiens
  misc_feature: HIJSMM301AQ5FG.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggtcaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtt

SEQ ID NO: 551900 - DNA, 490 bp, Homo sapiens
  misc_feature: HIJSMM301CO3GI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtttacagtacccccctcactttcggcggagggaccaaggcggagatcagacgaactgtggctgcaccatctgtcttcta

SEQ ID NO: 551901 - DNA, 504 bp, Homo sapiens; identical to SEQ ID NO: 538940
  misc_feature: HIJSMM301EG5Q6.2.35.D02.1.454.light.4.raw

SEQ ID NO: 551902 - DNA, 458 bp, Homo sapiens
  misc_feature: HIJSMM301DDBIL.41.12.B01.1.454.light.4.raw
tctatactatcacgaccggtgctcgatttagtagtgtagattccgcgggcacgaccggtgctcgatttagtagtgtagattccgcggcacgaccggtgctcgatttagatagcttcgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 551903 - DNA, 494 bp, Homo sapiens
  misc_feature: HIJSMM301ASZBT.43.4.A04.1.454.light.4.raw
tgtgagtagtcacgaccggtgctcgatttagagtagtgatcagggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggtccaagggaccgaacggtaggacgatcaaacgaactagtggctgcaccat

SEQ ID NO: 551904 - DNA, 441 bp, Homo sapiens; identical to SEQ ID NO: 535074
  misc_feature: HIJSMM301EKPWJ.11.3.A03.1.454.light.4.raw

SEQ ID NO: 551905 - DNA, 447 bp, Homo sapiens; identical to SEQ ID NO: 535020
  misc_feature: HIJSMM301CHE3D.18.9.A09.1.454.light.4.raw

SEQ ID NO: 551906 - DNA, 501 bp, Homo sapiens; identical to SEQ ID NO: 535746
  misc_feature: HIJSMM301DPRSB.18.11.A11.1.454.light.4.raw

SEQ ID NO: 551907 - DNA, 485 bp, Homo sapiens; identical to SEQ ID NO: 536630
  misc_feature: HIJSMM301B7CUW.13.56.F01.1.454.light.4.raw

SEQ ID NO: 551908 - DNA, 485 bp, Homo sapiens
  misc_feature: HIJSMM301EPZV3.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggccccgctcattttcggcggagggaccaaggtgcagatcaaacgaactgtggctgca

SEQ ID NO: 551909 - DNA, 513 bp, Homo sapiens
  misc_feature: HIJSMM301AW0A6.43.59.F04.1.454.light.4.raw
tgtgagtagtcacgaccggtgctcgatttagtacacacacttagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccct

SEQ ID NO: 551910 - DNA, 490 bp, Homo sapiens; identical to SEQ ID NO: 542820
  misc_feature: HIJSMM301ELX56.11.12.B01.1.454.light.4.raw

SEQ ID NO: 551911 - DNA, 510 bp, Homo sapiens; identical to SEQ ID NO: 535474
  misc_feature: HIJSMM301EN05J.17.33.C11.1.454.light.4.raw

SEQ ID NO: 551912 - DNA, 503 bp, Homo sapiens
  misc_feature: HIJSMM301BTG2Y.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaaagtagatgtcaaacgaactgtggctgcaccatctgtctt

SEQ ID NO: 551913 - DNA, 517 bp, Homo sapiens; identical to SEQ ID NO: 538938
  misc_feature: HIJSMM301BJC98.7.86.H09.1.454.light.4.raw

SEQ ID NO: 551914 - DNA, 484 bp, Homo sapiens
  misc_feature: HIJSMM301DIXBD.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtgg

SEQ ID NO: 551915 - DNA, 500 bp, Homo sapiens
  misc_feature: HIJSMM301D05XA.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtctt

SEQ ID NO: 551916 - DNA, 494 bp, Homo sapiens; identical to SEQ ID NO: 534992
  misc_feature: HIJSMM301CD2OX.9.1.A01.1.454.light.4.raw

SEQ ID NO: 551917 - DNA, 515 bp, Homo sapiens
  misc_feature: HIJSMM301ALR0D.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggaggggaccaagctgaccgtccttggtcagcccaaggctgccccctcggtcactctgttcccta

SEQ ID NO: 551918 - DNA, 509 bp, Homo sapiens
  misc_feature: HIJSMM301D7WG8.8.28.C06.1.454.light.4.raw
  modified_base (433)..(433): a, c, t, g, unknown or other
ctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctganactggcgttcactttcggcggagggaccgaaggtggacctacaaaccgaacgtgtggctgcaccatctgtcttcta

SEQ ID NO: 551919 - DNA, 508 bp, Homo sapiens
  misc_feature: HIJSMM301AQOGZ.8.28.C06.1.454.light.4.raw
ctcgcgtgtccacgaccggtgctcgatttagagctcacgtattgggtttgggggaacgtgctcagttaggacccacgacggaaccatggaagccccacgcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccaaggtggacctcaaacgaactgtggctgcaccatctgtcttcatcttcccgccat

SEQ ID NO: 551920 - DNA, 491 bp, Homo sapiens
  misc_feature: HIJSMM301ANVKM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggagggaccgaagacggagatcagacgaactgtggctcgcaccactctcgtcttcta

SEQ ID NO: 551921 - DNA, 508 bp, Homo sapiens
  misc_feature: HIJSMM301A5AEC.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagccctgaagattttgcaacttactactgtcaacagagtttcagtgtcccccggacgttcgccacgggacgacacgtagaatagagacgaactagtggctgcaccgactcctgtcttctatcttcccgt

SEQ ID NO: 551922 - DNA, 441 bp, Homo sapiens; identical to SEQ ID NO: 534971
  misc_feature: HIJSMM301EPQWA.11.3.A03.1.454.light.4.raw

SEQ ID NO: 551923 - DNA, 441 bp, Homo sapiens; identical to SEQ ID NO: 534971
  misc_feature: HIJSMM301B8YQ4.11.3.A03.1.454.light.4.raw

SEQ ID NO: 551924 - DNA, 504 bp, Homo sapiens; identical to SEQ ID NO: 538423
  misc_feature: HIJSMM301DEZ4R.48.67.G01.1.454.light.4.raw

SEQ ID NO: 551925 - DNA, 486 bp, Homo sapiens; identical to SEQ ID NO: 535043
  misc_feature: HIJSMM301CL9H8.46.35.D02.1.454.light.4.raw

SEQ ID NO: 551926 - DNA, 487 bp, Homo sapiens
  misc_feature: HIJSMM301EQ3AJ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaacgaactgtggctgcacca

SEQ ID NO: 551927 - DNA, 496 bp, Homo sapiens; identical to SEQ ID NO: 538149
  misc_feature: HIJSMM301DVDF2.13.67.G01.1.454.light.4.raw

SEQ ID NO: 551928 - DNA, 489 bp, Homo sapiens; identical to SEQ ID NO: 542614
  misc_feature: HIJSMM301BF0AX.48.75.G09.1.454.light.4.raw

SEQ ID NO: 551929 - DNA, 498 bp, Homo sapiens; identical to SEQ ID NO: 535295
  misc_feature: HIJSMM301CQDTB.15.25.C03.1.454.light.4.raw

SEQ ID NO: 551930 - DNA, 503 bp, Homo sapiens
  misc_feature: HIJSMM301BELMX.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaattatttttctatcctccgtggacgttcggccaagggaccagggtggaaatcagacgaactgtggctgcaccat

SEQ ID NO: 551931 - DNA, 515 bp, Homo sapiens
  misc_feature: HIJSMM301AU7ZL.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccaccctcctcgacacgcg

SEQ ID NO: 551932 - DNA, 498 bp, Homo sapiens
  misc_feature: HIJSMM301ALO9N.43.34.D01.1.454.light.4.raw
tgtgagtagtcacgaccggtgctcgatttagatcgtctgtgttgggtttgggggggcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 551933 - DNA, 512 bp, Homo sapiens; identical to SEQ ID NO: 541300
  misc_feature: HIJSMM301DXFBL.17.33.C11.1.454.light.4.raw

SEQ ID NO: 551934 - DNA, 484 bp, Homo sapiens
  misc_feature: HIJSMM301CGEHQ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtccgctcactttcggcggagggaccaaggtggagatcaaacgaac

SEQ ID NO: 551935 - DNA, 485 bp, Homo sapiens; identical to SEQ ID NO: 536040
  misc_feature: HIJSMM301EBQF6.15.1.A01.1.454.light.4.raw

SEQ ID NO: 551936 - DNA, 454 bp, Homo sapiens; identical to SEQ ID NO: 534964
  misc_feature: HIJSMM301CNVDC.19.86.H09.1.454.light.4.raw

SEQ ID NO: 551937 - DNA, 484 bp, Homo sapiens; identical to SEQ ID NO: 535400
  misc_feature: HIJSMM301A9T10.46.26.C04.1.454.light.4.raw

SEQ ID NO: 551938 - DNA, 485 bp, Homo sapiens
  misc_feature: HIJSMM301DQMQC.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtaccccccccacgttcggccggaggaccacagtcgagatcaaacgaactgtggctgcaccat

SEQ ID NO: 551939 - DNA, 496 bp, Homo sapiens
  misc_feature: HIJSMM301EIJ7R.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 551940 - DNA, 492 bp, Homo sapiens
  misc_feature: HIJSMM301EKT6V.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctcccgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 551941 - DNA, 454 bp, Homo sapiens
  misc_feature: HIJSMM301B1IKT.19.71.G05.1.454.light.4.raw
tactctcgtgcacgaccggtgctcgatttagtgtcgtcgcaagagagaggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 551942 - DNA, 522 bp, Homo sapiens
  misc_feature: HIJSMM301D87D1.43.67.G01.1.454.light.4.raw
tgtgagtagtcacgaccggtgctcgatttagagtatacatattgggtttgggggctacaacaggcaggcaggggcgagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactcccgccgacgttcggccgggggaccgacccgtggtaaagtactaaacgaaactagtggcgtgcgaccatctgttcttcta

SEQ ID NO: 551943 - DNA, 491 bp, Homo sapiens
  misc_feature: HIJSMM301BU7AS.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttccatcttcccgcc

SEQ ID NO: 551944 - DNA, 494 bp, Homo sapiens
  misc_feature: HIJSMM301CT0K4.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtcccccggacgttcgccaaggaccgaacggtggacgatcaaacgaactagtggctgcaccatctgtctt

SEQ ID NO: 551945 - DNA, 487 bp, Homo sapiens; identical to SEQ ID NO: 536206
  misc_feature: HIJSMM301AUV3D.47.38.D05.1.454.light.4.raw

SEQ ID NO: 551946 - DNA, 491 bp, Homo sapiens
  misc_feature: HIJSMM301CGNRU.11.81.H04.1.454.light.4.raw
  modified_base (402)..(402): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttacngtcagcagtatagtaactggcctccgtacacttttggccaggggaccaagctagaaatcaaacgactgtggctgcaccatctgtcttca

SEQ ID NO: 551947 - DNA, 481 bp, Homo sapiens
  misc_feature: HIJSMM301EDNG7.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacagtggagatcaaacgaaactgtggctgcaccat

SEQ ID NO: 551948 - DNA, 512 bp, Homo sapiens
  misc_feature: HIJSMM301ER9XB.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaaggcccaaccccactgtcactctgtt

SEQ ID NO: 551949 - DNA, 495 bp, Homo sapiens
  misc_feature: HIJSMM301DV01C.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtggagatcaaacgaactgtggctgcaccatctgtctt

SEQ ID NO: 551950 - DNA, 480 bp, Homo sapiens
  misc_feature: HIJSMM301ETCJJ.10.4.A04.1.454.light.4.raw
catagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggaccaagctgaccgtcctaggtcagcccaaggctgcccctc

SEQ ID NO: 551951 - DNA, 508 bp, Homo sapiens
  misc_feature: HIJSMM301EOSGJ.8.55.E11.1.454.light.4.raw
ctcgcgtgtccacgaccggtgctcgatttagcactcgcacggttggggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtggtcttcggcggagggaccaagctgaccgtccttagtcaggcccaagg

SEQ ID NO: 551952 - DNA, 494 bp, Homo sapiens; identical to SEQ ID NO: 535828
  misc_feature: HIJSMM301C7QH1.3.36.D03.1.454.light.4.raw

SEQ ID NO: 551953 - DNA, 444 bp, Homo sapiens; identical to SEQ ID NO: 535856
  misc_feature: HIJSMM301B1R2K.9.9.A09.1.454.light.4.raw

SEQ ID NO: 551954 - DNA, 504 bp, Homo sapiens
  misc_feature: HIJSMM301AXYT2.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagttttattactgtcagcaattatttttctatcctccgtggacgttcggccaagggaccagggtgaaatcagacgaactgtggctgcaccatctgtctt

SEQ ID NO: 551955 - DNA, 481 bp, Homo sapiens; identical to SEQ ID NO: 545581
  misc_feature: HIJSMM301EPZYR.48.19.B08.1.454.light.4.raw

SEQ ID NO: 551956 - DNA, 508 bp, Homo sapiens; identical to SEQ ID NO: 541988
  misc_feature: HIJSMM301CIXGV.5.60.F05.1.454.light.4.raw

SEQ ID NO: 551957 - DNA, 494 bp, Homo sapiens; identical to SEQ ID NO: 534992
  misc_feature: HIJSMM301AO7WE.9.1.A01.1.454.light.4.raw

SEQ ID NO: 551958 - DNA, 486 bp, Homo sapiens; identical to SEQ ID NO: 551175
  misc_feature: HIJSMM301AZAEL.41.33.C11.1.454.light.4.raw

SEQ ID NO: 551959 - DNA, 444 bp, Homo sapiens; identical to SEQ ID NO: 537971
  misc_feature: HIJSMM301ER3ZD.2.76.G10.1.454.light.4.raw

SEQ ID NO: 551960 - DNA, 510 bp, Homo sapiens; identical to SEQ ID NO: 542037
  misc_feature: HIJSMM301DRUPT.4.57.F02.1.454.light.4.raw

SEQ ID NO: 551961 - DNA, 448 bp, Homo sapiens
  misc_feature: HIJSMM301EEN3J.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggcccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 551962 - DNA, 473 bp, Homo sapiens; identical to SEQ ID NO: 538875
  misc_feature: HIJSMM301ENYSB.4.75.G09.1.454.light.4.raw

SEQ ID NO: 551963 - DNA, 485 bp, Homo sapiens
  misc_feature: HIJSMM301B6626.49.35.D02.1.454.light.4.raw
agtcgagagacacgaccggtgctcgatttagcacacgatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaac

SEQ ID NO: 551964 - DNA, 513 bp, Homo sapiens
  misc_feature: HIJSMM301B2QEY.48.12.B01.1.454.light.4.raw
agtatacatacacgaccggtgctcgatttagtagtgtagattccgcgggcacgaccggtgctcgatttagtcacgcgagaaagggaaaggggctgggcctcaggaagcagcatcgggggtgccgcagccatggcctggaccgctctccttctgagcctccttgctcactttacagattctgtggcctcctatgaattgactcagcccttctcagtgtcggtggccctggggcagacggccaggatgacctgtgggggaaacaaaattggaagtaaagatgtgcactggtatcagcacaagccaggccaggcccctctactggtcatttatagggataccaatcggccctctgggatccctgagcggatctctggctccaactcggggaacacggccaccctgaccatcagcggggcccaagccggggatgaggctgactatttctgtcaggtgtgggacagcagcagtgtgattttcggcggcgggaccaagctgaccgtcctaggtcagccc

SEQ ID NO: 551965 - DNA, 460 bp, Homo sapiens; identical to SEQ ID NO: 537107
  misc_feature: HIJSMM301B71BF.22.28.C06.1.454.light.4.raw

SEQ ID NO: 551966 - DNA, 519 bp, Homo sapiens
  misc_feature: HIJSMM301BDUBJ.43.59.F04.1.454.light.4.raw
tgtgagtagtcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 551967 - DNA, 496 bp, Homo sapiens; identical to SEQ ID NO: 542375
  misc_feature: HIJSMM301C7F71.7.59.F04.1.454.light.4.raw

SEQ ID NO: 551968 - DNA, 488 bp, Homo sapiens; identical to SEQ ID NO: 535081
  misc_feature: HIJSMM301A3WZ4.26.23.C01.1.454.light.4.raw

SEQ ID NO: 551969 - DNA, 468 bp, Homo sapiens
  misc_feature: HIJSMM301BRZYL.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacacttttcggcggagggaccaaggtggagatcaaacgaaa

SEQ ID NO: 551970 - DNA, 503 bp, Homo sapiens; identical to SEQ ID NO: 551912
  misc_feature: HIJSMM301DBQ7P.12.50.E06.1.454.light.4.raw

SEQ ID NO: 551971 - DNA, 473 bp, Homo sapiens; identical to SEQ ID NO: 541472
  misc_feature: HIJSMM301DREHU.5.12.B01.1.454.light.4.raw

SEQ ID NO: 551972 - DNA, 494 bp, Homo sapiens; identical to SEQ ID NO: 534992
  misc_feature: HIJSMM301EXXJG.9.1.A01.1.454.light.4.raw

SEQ ID NO: 551973 - DNA, 497 bp, Homo sapiens
  misc_feature: HIJSMM301A1NT8.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactacgtggctggcaccatctgtt

SEQ ID NO: 551974 - DNA, 504 bp, Homo sapiens
  misc_feature: HIJSMM301BFGVG.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 551975 - DNA, 499 bp, Homo sapiens
  misc_feature: HIJSMM301B0ZZF.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcact

SEQ ID NO: 551976 - DNA, 492 bp, Homo sapiens; identical to SEQ ID NO: 539815
  misc_feature: HIJSMM301CE3F8.51.81.H04.1.454.light.4.raw

SEQ ID NO: 551977 - DNA, 521 bp, Homo sapiens
  misc_feature: HIJSMM301AMI0E.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaacgaactacgtggcgtgcaccactctgtcttctatcttcccgtcccact

SEQ ID NO: 551978 - DNA, 517 bp, Homo sapiens; identical to SEQ ID NO: 536262
  misc_feature: HIJSMM301CROG5.14.70.G04.1.454.light.4.raw

SEQ ID NO: 551979 - DNA, 502 bp, Homo sapiens; identical to SEQ ID NO: 536604
  misc_feature: HIJSMM301B7223.27.78.H01.1.454.light.4.raw

SEQ ID NO: 551980 - DNA, 516 bp, Homo sapiens
  misc_feature: HIJSMM301E087G.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccgaaggaccgaacggtaggaagtacgaacgaaactagtaggcgtgcaccactctgtcttctactcttcccgtcccact

SEQ ID NO: 551981 - DNA, 486 bp, Homo sapiens; identical to SEQ ID NO: 535043
  misc_feature: HIJSMM301DPZ62.46.35.D02.1.454.light.4.raw

SEQ ID NO: 551982 - DNA, 496 bp, Homo sapiens; identical to SEQ ID NO: 535109
  misc_feature: HIJSMM301AIMOB.16.78.H01.1.454.light.4.raw

SEQ ID NO: 551983 - DNA, 491 bp, Homo sapiens; identical to SEQ ID NO: 535294
  misc_feature: HIJSMM301C2IS5.16.68.G02.1.454.light.4.raw

SEQ ID NO: 551984 - DNA, 489 bp, Homo sapiens
  misc_feature: HIJSMM301B8H7D.43.34.D01.1.454.light.4.raw
tgtgagtagtcacgaccggtgctcgatttagatcgtctgtggttgggtttggggagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcggccaagggaccaaggtggaaatcaaaacgaactgtggctgcaccat

SEQ ID NO: 551985 - DNA, 404 bp, Homo sapiens; identical to SEQ ID NO: 535530
  misc_feature: HIJSMM301BXXWQ.4.35.D02.1.454.light.4.raw

SEQ ID NO: 551986 - DNA, 499 bp, Homo sapiens
  misc_feature: HIJSMM301BZIU2.15.71.G05.1.454.light.4.raw
tctacgtagccacgaccggtgctcgatttagtgtcgtcgcaagagagagggggtcaggctggaactgaggagcgaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggtattttgctaacttactattgtcaacaggctaacagtttccctctctactttcggcggaggaccgaaggtggatatcaaacgaactgtggctgcaccta

SEQ ID NO: 551987 - DNA, 494 bp, Homo sapiens
  misc_feature: HIJSMM301CPD17.3.78.H01.1.454.light.4.raw
agacgcactccacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaacgaactgtggctgcaccatctgtcttcta

SEQ ID NO: 551988 - DNA, 497 bp, Homo sapiens
  misc_feature: HIJSMM301AEGSX.52.35.D02.1.454.light.4.raw
cgcagtacgacacgaccggtgctcgatttagcacacgatagttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 551989 - DNA, 509 bp, Homo sapiens
  misc_feature: HIJSMM301DPIK0.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctcgccccctcggtcactctgttccccta

SEQ ID NO: 551990 - DNA, 497 bp, Homo sapiens; identical to SEQ ID NO: 536371
  misc_feature: HIJSMM301EHY0R.16.78.H01.1.454.light.4.raw

SEQ ID NO: 551991 - DNA, 486 bp, Homo sapiens; identical to SEQ ID NO: 535385
  misc_feature: HIJSMM301ERI6K.19.71.G05.1.454.light.4.raw

SEQ ID NO: 551992 - DNA, 495 bp, Homo sapiens
  misc_feature: HIJSMM301DLF8L.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaaggaccaaggtggaaatcaaacgaactgtggctgcaccatctgtctt

SEQ ID NO: 551993 - DNA, 493 bp, Homo sapiens; identical to SEQ ID NO: 544335
  misc_feature: HIJSMM301C3GRA.5.57.F02.1.454.light.4.raw

SEQ ID NO: 551994 - DNA, 501 bp, Homo sapiens; identical to SEQ ID NO: 537262
  misc_feature: HIJSMM301ESWLU.8.55.E11.1.454.light.4.raw

SEQ ID NO: 551995 - DNA, 486 bp, Homo sapiens; identical to SEQ ID NO: 535043
  misc_feature: HIJSMM301CLMI4.46.35.D02.1.454.light.4.raw

SEQ ID NO: 551996 - DNA, 503 bp, Homo sapiens
  misc_feature: HIJSMM301B22G8.48.87.H10.1.454.light.4.raw
agtatacatacacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatagtcaatcgaactgtggctgcaccatctgtcttcatt

SEQ ID NO: 551997 - DNA, 518 bp, Homo sapiens; identical to SEQ ID NO: 539372
  misc_feature: HIJSMM301EHIRU.7.86.H09.1.454.light.4.raw

SEQ ID NO: 551998 - DNA, 447 bp, Homo sapiens
  misc_feature: HIJSMM301CLY1U.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaat

SEQ ID NO: 551999 - DNA, 486 bp, Homo sapiens; identical to SEQ ID NO: 535043
  misc_feature: HIJSMM301AHWDE.46.35.D02.1.454.light.4.raw

SEQ ID NO: 552000 - DNA, 486 bp, Homo sapiens
  misc_feature: HIJSMM301EIO3T.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaagggaccgaaggtaggaaagtacaaacgaaactagtgg

SEQ ID NO: 552001 - DNA, 493 bp, Homo sapiens
  misc_feature: HIJSMM301DZLUY.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcacc

SEQ ID NO: 552002 - DNA, 465 bp, Homo sapiens
  misc_feature: HIJSMM301ARLQE.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaacgaa

SEQ ID NO: 552003 - DNA, 503 bp, Homo sapiens
  misc_feature: HIJSMM301BTYTZ.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgtccccccg

SEQ ID NO: 552004 - DNA, 495 bp, Homo sapiens; identical to SEQ ID NO: 535821
  misc_feature: HIJSMM301DCD16.3.31.C09.1.454.light.4.raw

SEQ ID NO: 552005 - DNA, 488 bp, Homo sapiens
  misc_feature: HIJSMM301E29Q1.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataataacctggcctccgctcacttcgtcggacgggacgaacggtaggtagagtacaaacgaaactaacgt

SEQ ID NO: 552006 - DNA, 495 bp, Homo sapiens
  misc_feature: HIJSMM301BPWVP.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaacg

SEQ ID NO: 552007 - DNA, 457 bp, Homo sapiens
  misc_feature: HIJSMM301BUC3E.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaccagggacagcccctaagctcctgatcctcgatgcatccactttggaaacagggtcccatcaaggttcagtggaagtggctctgggacagattttactttcaccatcagcagactgcagcctgaagatattgcaacatattactgtcaacagtatgatagtctccgctcactttcggcggagggaccaagtggagatcaacgaa

SEQ ID NO: 552008 - DNA, 491 bp, Homo sapiens; identical to SEQ ID NO: 535176
  misc_feature: HIJSMM301BKAQD.13.39.D06.1.454.light.4.raw

SEQ ID NO: 552009 - DNA, 501 bp, Homo sapiens; identical to SEQ ID NO: 542520
  misc_feature: HIJSMM301BUMF5.10.43.D10.1.454.light.4.raw

SEQ ID NO: 552010 - DNA, 516 bp, Homo sapiens
  misc_feature: HIJSMM301EI9GW.7.86.H09.1.454.light.4.raw
cgtgtctctacacgaccggtgctcgatttagtgctatagacttgggtttggggagagctctggagaagagctgctcagttaggacccagagggaacatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccg

SEQ ID NO: 552011 - DNA, 454 bp, Homo sapiens
  misc_feature: HIJSMM301CK1N8.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgccccctcggtcactctgttcccaccctcctccacgagagta

SEQ ID NO: 552012 - DNA, 515 bp, Homo sapiens
  misc_feature: HIJSMM301DD5CL.48.69.G03.1.454.light.4.raw
agtatacatacacgaccggtgctcgatttagtcgctgcgtaaaggagaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccg

SEQ ID NO: 552013 - DNA, 483 bp, Homo sapiens
  misc_feature: HIJSMM301CKWSV.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtctaggtcagcccaaggctgcccccg

SEQ ID NO: 552014 - DNA, 491 bp, Homo sapiens; identical to SEQ ID NO: 543372
  misc_feature: HIJSMM301CLXQC.47.55.E11.1.454.light.4.raw

SEQ ID NO: 552015 - DNA, 505 bp, Homo sapiens
  misc_feature: HIJSMM301CY2V2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtctt

SEQ ID NO: 552016 - DNA, 497 bp, Homo sapiens; identical to SEQ ID NO: 535740
  misc_feature: HIJSMM301AD9RP.3.71.G05.1.454.light.4.raw

SEQ ID NO: 552017 - DNA, 444 bp, Homo sapiens; identical to SEQ ID NO: 535594
  misc_feature: HIJSMM301C83W6.9.9.A09.1.454.light.4.raw

SEQ ID NO: 552018 - DNA, 498 bp, Homo sapiens
  misc_feature: HIJSMM301CDBA1.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgtagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgctagtttattactgtcagcagcgtagcaatttgatcaccttcggccaaggacacgactaggaaattaaacgaactgtggctgcaccatctgtcttcatcttcccgccat

SEQ ID NO: 552019 - DNA, 484 bp, Homo sapiens; identical to SEQ ID NO: 535400
  misc_feature: HIJSMM301A60UB.46.26.C04.1.454.light.4.raw

SEQ ID NO: 552020 - DNA, 502 bp, Homo sapiens
  misc_feature: HIJSMM301CJCDL.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggt

SEQ ID NO: 552021 - DNA, 447 bp, Homo sapiens; identical to SEQ ID NO: 535020
  misc_feature: HIJSMM301B9532.18.9.A09.1.454.light.4.raw

SEQ ID NO: 552022 - DNA, 454 bp, Homo sapiens; identical to SEQ ID NO: 534964
  misc_feature: HIJSMM301AJZQS.19.86.H09.1.454.light.4.raw

SEQ ID NO: 552023 - DNA, 514 bp, Homo sapiens
  misc_feature: HIJSMM301CIFYW.14.7.A07.1.454.light.4.raw
  modified_base (442)..(442): a, c, t, g, unknown or other
  modified_base (461)..(461): a, c, t, g, unknown or other
  modified_base (478)..(478): a, c, t, g, unknown or other
  modified_base (490)..(490): a, c, t, g, unknown or other
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcacccatcacgggggcccaggcagatgatgaatactaattatcactgtgngtgtatatggtttggtcgnttcgttgttcggtcggnggaccggacggngacgtccgacgtcacgccacgacg

SEQ ID NO: 552024 - DNA, 475 bp, Homo sapiens
  misc_feature: HIJSMM301B7N0I.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtggatgtcaaccgaactgtggctgcacc

SEQ ID NO: 552025 - DNA, 505 bp, Homo sapiens
  misc_feature: HIJSMM301ADIWW.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccacctgtcactctcg

SEQ ID NO: 552026 - DNA, 482 bp, Homo sapiens
  misc_feature: HIJSMM301A00CB.13.4.A04.1.454.light.4.raw
  modified_base (475)..(475): a, c, t, g, unknown or other
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccaagggacacgacgaggaagtaacgtaaacgacgtgcgtncgacact

SEQ ID NO: 552027 - DNA, 414 bp, Homo sapiens
  misc_feature: HIJSMM301AJQQM.4.61.F06.1.454.light.4.raw
agcactgtagcacgaccggtgctcgatttagctacgctctaagggaaaggggaagacaatgggtttgatttagatcacagaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgccatctgactacagtgct

SEQ ID NO: 552028 - DNA, 485 bp, Homo sapiens; identical to SEQ ID NO: 535880
  misc_feature: HIJSMM301AQB72.7.75.G09.1.454.light.4.raw

SEQ ID NO: 552029 - DNA, 498 bp, Homo sapiens; identical to SEQ ID NO: 542913
  misc_feature: HIJSMM301AEJKM.51.26.C04.1.454.light.4.raw

SEQ ID NO: 552030 - DNA, 495 bp, Homo sapiens; identical to SEQ ID NO: 535596
  misc_feature: HIJSMM301DZ14L.10.79.H02.1.454.light.4.raw

SEQ ID NO: 552031 - DNA, 521 bp, Homo sapiens
  misc_feature: HIJSMM301DZ55A.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtcccccaccactgtgatctatgaggatgaccaaacgaacctcctggggtcccgtaactcggttctctggctccgtcgacacctcctccaactctgcctacctcaccatctctggactgaagaactgaggacggaggctgactattactgtcactcttatgatcgcaacaaacagggtgttcggcggagggaccgaggttgaccgtcccttggttcacgcccaacggctgccccctcccggtcactctgttcccgt

SEQ ID NO: 552032 - DNA, 496 bp, Homo sapiens; identical to SEQ ID NO: 535109
  misc_feature: HIJSMM301D945D.16.78.H01.1.454.light.4.raw

SEQ ID NO: 552033 - DNA, 488 bp, Homo sapiens; identical to SEQ ID NO: 535861
  misc_feature: HIJSMM301BGGUR.14.55.E11.1.454.light.4.raw

SEQ ID NO: 552034 - DNA, 389 bp, Homo sapiens; identical to SEQ ID NO: 540091
  misc_feature: HIJSMM301BWDAE.21.40.D07.1.454.light.4.raw

SEQ ID NO: 552035 - DNA, 478 bp, Homo sapiens; identical to SEQ ID NO: 535129
  misc_feature: HIJSMM301A62EX.11.11.A11.1.454.light.4.raw

SEQ ID NO: 552036 - DNA, 513 bp, Homo sapiens
  misc_feature: HIJSMM301BDY6F.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcccttct

SEQ ID NO: 552037 - DNA, 477 bp, Homo sapiens; identical to SEQ ID NO: 537931
  misc_feature: HIJSMM301EIL7R.48.5.A05.1.454.light.4.raw

SEQ ID NO: 552038 - DNA, 484 bp, Homo sapiens; identical to SEQ ID NO: 535441
  misc_feature: HIJSMM301ALIYO.26.60.F05.1.454.light.4.raw

SEQ ID NO: 552039 - DNA, 502 bp, Homo sapiens; identical to SEQ ID NO: 538730
  misc_feature: HIJSMM301EKJOU.15.1.A01.1.454.light.4.raw

SEQ ID NO: 552040 - DNA, 454 bp, Homo sapiens; identical to SEQ ID NO: 534964
  misc_feature: HIJSMM301A0ZYD.19.86.H09.1.454.light.4.raw

SEQ ID NO: 552041 - DNA, 468 bp, Homo sapiens
  misc_feature: HIJSMM301B6JF2.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctggtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatacg

SEQ ID NO: 552042 - DNA, 501 bp, Homo sapiens
  misc_feature: HIJSMM301CB4F4.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcattt

SEQ ID NO: 552043 - DNA, 447 bp, Homo sapiens; identical to SEQ ID NO: 535201
  misc_feature: HIJSMM301D127V.18.9.A09.1.454.light.4.raw

SEQ ID NO: 552044 - DNA, 493 bp, Homo sapiens; identical to SEQ ID NO: 543205
  misc_feature: HIJSMM301EQ2X0.51.6.A06.1.454.light.4.raw

SEQ ID NO: 552045 - DNA, 494 bp, Homo sapiens; identical to SEQ ID NO: 536444
  misc_feature: HIJSMM301C7ED5.26.72.G06.1.454.light.4.raw

SEQ ID NO: 552046 - DNA, 506 bp, Homo sapiens
  misc_feature: HIJSMM301DN19R.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggccgggaccaaagtggaaatcaaacgaactgtggctgcaccatctgtcttcatcttcccgcat

SEQ ID NO: 552047 - DNA, 494 bp, Homo sapiens
  misc_feature: HIJSMM301B0VRY.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggacccaggtggagatcagacgaactgtggctgcaccatctgtcttcatcttcccg

SEQ ID NO: 552048 - DNA, 494 bp, Homo sapiens
  misc_feature: HIJSMM301CGBF2.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcacgtccaaggtcacg

SEQ ID NO: 552049 - DNA, 496 bp, Homo sapiens
  misc_feature: HIJSMM301EAWE9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatactgtcagcagtataataactggcctccacggtacacttttggcctaggggaccaagctggagatcaaacgaactgtggctgcaccatctgt

SEQ ID NO: 552050 - DNA, 493 bp, Homo sapiens; identical to SEQ ID NO: 537281
  misc_feature: HIJSMM301BO1EX.9.1.A01.1.454.light.4.raw

SEQ ID NO: 552051 - DNA, 489 bp, Homo sapiens; identical to SEQ ID NO: 546186
  misc_feature: HIJSMM301BMZC8.52.85.H08.1.454.light.4.raw

SEQ ID NO: 552052 - DNA, 455 bp, Homo sapiens
  misc_feature: HIJSMM301CLE6C.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccaccctcctccacgagagta

SEQ ID NO: 552053 - DNA, 484 bp, Homo sapiens; identical to SEQ ID NO: 551470
  misc_feature: HIJSMM301B54Y7.10.1.A01.1.454.light.4.raw

SEQ ID NO: 552054 - DNA, 490 bp, Homo sapiens; identical to SEQ ID NO: 535234
  misc_feature: HIJSMM301COZ5K.17.21.B10.1.454.light.4.raw

SEQ ID NO: 552055 - DNA, 484 bp, Homo sapiens; identical to SEQ ID NO: 535240
  misc_feature: HIJSMM301D5PKT.47.60.F05.1.454.light.4.raw

SEQ ID NO: 552056 - DNA, 494 bp, Homo sapiens; identical to SEQ ID NO: 535276
  misc_feature: HIJSMM301C1GV1.16.6.A06.1.454.light.4.raw

SEQ ID NO: 552057 - DNA, 515 bp, Homo sapiens
  misc_feature: HIJSMM301CAE3K.9.20.B09.1.454.light.4.raw
  modified_base (497)..(497): a, c, t, g, unknown or other
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagccaaggctgccccctcggtcactcctgttcccnccctcctcagacgtatca

SEQ ID NO: 552058 - DNA, 516 bp, Homo sapiens
  misc_feature: HIJSMM301BG8Z0.51.27.C05.1.454.light.4.raw
cgatcgtatacacgaccggtgctcgatttagacgcgatcgaagggtttgggcacgaccgtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtccg

SEQ ID NO: 552059 - DNA, 518 bp, Homo sapiens; identical to SEQ ID NO: 539372
  misc_feature: HIJSMM301AEWLE.7.86.H09.1.454.light.4.raw

SEQ ID NO: 552060 - DNA, 505 bp, Homo sapiens; identical to SEQ ID NO: 535503
  misc_feature: HIJSMM301EU769.8.28.C06.1.454.light.4.raw

SEQ ID NO: 552061 - DNA, 507 bp, Homo sapiens
  misc_feature: HIJSMM301CGPBE.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccca

SEQ ID NO: 552062 - DNA, 507 bp, Homo sapiens
  misc_feature: HIJSMM301BUBGC.48.5.A05.1.454.light.4.raw
agtatacatacacgaccggtgctcgatttagatagatagacagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgatgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaaagcagccgatccagcctgcggagcctgtgggcaggtcagcccaaggccaacccactgtcactctcg

SEQ ID NO: 552063 - DNA, 487 bp, Homo sapiens; identical to SEQ ID NO: 539157
  misc_feature: HIJSMM301C33WN.26.37.D04.1.454.light.4.raw

SEQ ID NO: 552064 - DNA, 486 bp, Homo sapiens; identical to SEQ ID NO: 535043
  misc_feature: HIJSMM301CRFBV.46.35.D02.1.454.light.4.raw

SEQ ID NO: 552065 - DNA, 317 bp, Homo sapiens
  misc_feature: HIJSMM301D9ZU9.10.17.B06.1.454.light.4.raw
  modified_base (297)..(297): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcactccncgcgcatatcncncncgtgt

SEQ ID NO: 552066 - DNA, 507 bp, Homo sapiens
  misc_feature: HIJSMM301BPSRN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatacaaacgaactgtggctgcaccatctgtt

SEQ ID NO: 552067 - DNA, 496 bp, Homo sapiens; identical to SEQ ID NO: 543955
  misc_feature: HIJSMM301EL29L.7.59.F04.1.454.light.4.raw

SEQ ID NO: 552068 - DNA, 490 bp, Homo sapiens
  misc_feature: HIJSMM301CYK49.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaaactgtggctgcaccatctgtctt

SEQ ID NO: 552069 - DNA, 498 bp, Homo sapiens
  misc_feature: HIJSMM301AYDD4.10.79.H02.1.454.light.4.raw
catagtagtgcacgaccggtgctcgatttagtgtcacacgaaggggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggacttttggtccaggggaccaagctggaggatacaaacgaactgtggctgcaccatctgtctt

SEQ ID NO: 552070 - DNA, 497 bp, Homo sapiens; identical to SEQ ID NO: 535286
  misc_feature: HIJSMM301DUIHZ.18.59.F04.1.454.light.4.raw

SEQ ID NO: 552071 - DNA, 480 bp, Homo sapiens; identical to SEQ ID NO: 535291
  misc_feature: HIJSMM301E0YNK.22.59.F04.1.454.light.4.raw

SEQ ID NO: 552072 - DNA, 504 bp, Homo sapiens
  misc_feature: HIJSMM301CUNLE.22.21.B10.1.454.light.4.raw
acatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctggtcactcttcg

SEQ ID NO: 552073 - DNA, 483 bp, Homo sapiens
  misc_feature: HIJSMM301COIJH.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcaagacgaa

SEQ ID NO: 552074 - DNA, 488 bp, Homo sapiens; identical to SEQ ID NO: 535861
  misc_feature: HIJSMM301B3S63.14.55.E11.1.454.light.4.raw

SEQ ID NO: 552075 - DNA, 481 bp, Homo sapiens; identical to SEQ ID NO: 535993
  misc_feature: HIJSMM301DBPSD.21.25.C03.1.454.light.4.raw

SEQ ID NO: 552076 - DNA, 511 bp, Homo sapiens
  misc_feature: HIJSMM301CG50G.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgcctcct

SEQ ID NO: 552077 - DNA, 511 bp, Homo sapiens
  misc_feature: HIJSMM301B5QEK.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggtccggggaccgaccgtcggaaatcaaacgaaactgtggctgcaccatctgtctt

SEQ ID NO: 552078 - DNA, 494 bp, Homo sapiens; identical to SEQ ID NO: 534992
  misc_feature: HIJSMM301BZONU.9.1.A01.1.454.light.4.raw

SEQ ID NO: 552079 - DNA, 484 bp, Homo sapiens; identical to SEQ ID NO: 535240
  misc_feature: HIJSMM301B74GG.47.60.F05.1.454.light.4.raw

SEQ ID NO: 552080 - DNA, 505 bp, Homo sapiens
  misc_feature: HIJSMM301EQIEO.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttcccgccat

SEQ ID NO: 552081 - DNA, 495 bp, Homo sapiens
  misc_feature: HIJSMM301CXPXF.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgtccaacggaccgaaacgtaggacgatcaagacgaactagtggcgtgcaccactct

SEQ ID NO: 552082 - DNA, 480 bp, Homo sapiens
  misc_feature: HIJSMM301CCOIV.16.4.A04.1.454.light.4.raw
tgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgcaacctattattgccaacagtataatagttatccgtggacgttcggccaagggaccgacgggtggacgatcaaacgaaactgtggctgcacca

SEQ ID NO: 552083 - DNA, 486 bp, Homo sapiens
  misc_feature: HIJSMM301B81DJ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacacttttggccaggggaccaaactggacatcaaacgaactgtggctgcaccatctgt

SEQ ID NO: 552084 - DNA, 498 bp, Homo sapiens; identical to SEQ ID NO: 535974
  misc_feature: HIJSMM301BDNVX.22.27.C05.1.454.light.4.raw

SEQ ID NO: 552085 - DNA, 492 bp, Homo sapiens; identical to SEQ ID NO: 545637
  misc_feature: HIJSMM301DJIFU.48.1.A01.1.454.light.4.raw

SEQ ID NO: 552086 - DNA, 486 bp, Homo sapiens
  misc_feature: HIJSMM301EJYKK.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtgaggctgaagatgtcggggtttattactgcatgcagggtacagtgtggccttcgctcgcattcggcggagggaccaaggtggagatcaaacga

SEQ ID NO: 552087 - DNA, 500 bp, Homo sapiens
  misc_feature: HIJSMM301DJOC1.22.14.B03.1.454.light.4.raw
  modified_base (438)..(438): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatttaaaaatnttcctcctcagacgttcggccaaggaccaaggtggaaatcaaacgaactagtggctgcacca

SEQ ID NO: 552088 - DNA, 503 bp, Homo sapiens
  misc_feature: HIJSMM301EMUC1.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctggtcta

SEQ ID NO: 552089 - DNA, 490 bp, Homo sapiens; identical to SEQ ID NO: 535234
  misc_feature: HIJSMM301BVEXQ.17.21.B10.1.454.light.4.raw

SEQ ID NO: 552090 - DNA, 520 bp, Homo sapiens
  misc_feature: HIJSMM301CJJQJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgcctaggtcagcccaaggctgccccctcggtcactctgttcccgccct

SEQ ID NO: 552091 - DNA, 446 bp, Homo sapiens; identical to SEQ ID NO: 536034
  misc_feature: HIJSMM301CR7WG.18.9.A09.1.454.light.4.raw

SEQ ID NO: 552092 - DNA, 495 bp, Homo sapiens
  misc_feature: HIJSMM301DD6XO.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcaccatctgtcttt

SEQ ID NO: 552093 - DNA, 456 bp, Homo sapiens
  misc_feature: HIJSMM301DAT69.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgacgtcctaggtcagcccaaggctgccccctcggtcactctgttcccaccctcctctagtacgtga

SEQ ID NO: 552094 - DNA, 521 bp, Homo sapiens; identical to SEQ ID NO: 536990
  misc_feature: HIJSMM301BM0IT.27.23.C01.1.454.light.4.raw
  modified_base (517)..(517): a, c, t, g, unknown or other

SEQ ID NO: 552095 - DNA, 492 bp, Homo sapiens; identical to SEQ ID NO: 534967
  misc_feature: HIJSMM301ARCL3.47.64.F09.1.454.light.4.raw

SEQ ID NO: 552096 - DNA, 493 bp, Homo sapiens; identical to SEQ ID NO: 539015
  misc_feature: HIJSMM301CYZHP.27.78.H01.1.454.light.4.raw

SEQ ID NO: 552097 - DNA, 508 bp, Homo sapiens
  misc_feature: HIJSMM301AJKHG.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 552098 - DNA, 497 bp, Homo sapiens
  misc_feature: HIJSMM301B9EMF.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcaatgtccccaggacagacggccaagatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgccccctcggtcact

SEQ ID NO: 552099 - DNA, 482 bp, Homo sapiens
  misc_feature: HIJSMM301ED3K5.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttggctgttcggcggcgggaccg

SEQ ID NO: 552100 - DNA, 493 bp, Homo sapiens; identical to SEQ ID NO: 544666
  misc_feature: HIJSMM301DJMDP.12.23.C01.1.454.light.4.raw

SEQ ID NO: 552101 - DNA, 510 bp, Homo sapiens
  misc_feature: HIJSMM301B50XJ.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctcgttcccaccctcc

SEQ ID NO: 552102 - DNA, 481 bp, Homo sapiens
  misc_feature: HIJSMM301BPURR.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaatgagacgaactgtggctgcaccat

SEQ ID NO: 552103 - DNA, 485 bp, Homo sapiens; identical to SEQ ID NO: 538954
  misc_feature: HIJSMM301AHJK0.3.55.E11.1.454.light.4.raw

SEQ ID NO: 552104 - DNA, 504 bp, Homo sapiens; identical to SEQ ID NO: 538940
  misc_feature: HIJSMM301DP7YD.2.35.D02.1.454.light.4.raw

SEQ ID NO: 552105 - DNA, 498 bp, Homo sapiens
  misc_feature: HIJSMM301AEJ47.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcaccatctgtcttcatcttcccgccact

SEQ ID NO: 552106 - DNA, 454 bp, Homo sapiens; identical to SEQ ID NO: 542020
  misc_feature: HIJSMM301BY34K.19.86.H09.1.454.light.4.raw

SEQ ID NO: 552107 - DNA, 489 bp, Homo sapiens
  misc_feature: HIJSMM301CK24U.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaagtggacatcaagcgaactgtggctgcaccatctgt

SEQ ID NO: 552108 - DNA, 492 bp, Homo sapiens; identical to SEQ ID NO: 536010
  misc_feature: HIJSMM301A27LN.10.20.B09.1.454.light.4.raw

SEQ ID NO: 552109 - DNA, 513 bp, Homo sapiens
  misc_feature: HIJSMM301AXBKX.15.76.G10.1.454.light.4.raw
tctacgtagccacgaccggtgctcgatttagtcactcatacaggggggcgccaggggtccctttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcctcgctacg

SEQ ID NO: 552110 - DNA, 517 bp, Homo sapiens
  misc_feature: HIJSMM301DINLE.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttccccg

SEQ ID NO: 552111 - DNA, 492 bp, Homo sapiens; identical to SEQ ID NO: 536010
  misc_feature: HIJSMM301AS0YT.10.20.B09.1.454.light.4.raw

SEQ ID NO: 552112 - DNA, 511 bp, Homo sapiens
  misc_feature: HIJSMM301AIO3W.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttacggtcggacgggacgaacggaggacgatactacgacgaactacgtggtcgtcgtcgaccactcttcgttcttcctta

SEQ ID NO: 552113 - DNA, 501 bp, Homo sapiens
  misc_feature: HIJSMM301BBP1Y.53.30.C08.1.454.light.4.raw
cgcgtatacacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttcg

SEQ ID NO: 552114 - DNA, 483 bp, Homo sapiens
  misc_feature: HIJSMM301DELUV.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaacgaactgtggctgcacc

SEQ ID NO: 552115 - DNA, 484 bp, Homo sapiens; identical to SEQ ID NO: 537878
  misc_feature: HIJSMM301CUYIC.17.34.D01.1.454.light.4.raw

SEQ ID NO: 552116 - DNA, 519 bp, Homo sapiens; identical to SEQ ID NO: 548902
  misc_feature: HIJSMM301BLDN8.27.23.C01.1.454.light.4.raw

SEQ ID NO: 552117 - DNA, 444 bp, Homo sapiens; identical to SEQ ID NO: 535192
  misc_feature: HIJSMM301BKYZ7.5.9.A09.1.454.light.4.raw

SEQ ID NO: 552118 - DNA, 494 bp, Homo sapiens; identical to SEQ ID NO: 534994
  misc_feature: HIJSMM301C6F7P.27.78.H01.1.454.light.4.raw

SEQ ID NO: 552119 - DNA, 498 bp, Homo sapiens
  misc_feature: HIJSMM301CAB34.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttccc

SEQ ID NO: 552120 - DNA, 495 bp, Homo sapiens
  misc_feature: HIJSMM301BZU10.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcact

SEQ ID NO: 552121 - DNA, 509 bp, Homo sapiens; identical to SEQ ID NO: 536047
  misc_feature: HIJSMM301EEJ01.17.33.C11.1.454.light.4.raw

SEQ ID NO: 552122 - DNA, 508 bp, Homo sapiens
  misc_feature: HIJSMM301CU4Q1.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggccccctctccctcactttcggcgggggaccaaggtggagctcaacgaactgtggctgcaccatctgtcttcatcttcccg

SEQ ID NO: 552123 - DNA, 483 bp, Homo sapiens
  misc_feature: HIJSMM301CIMIE.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaactagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaacgggaccaaggtggaaatacaaacgaactagtggctgcacca

SEQ ID NO: 552124 - DNA, 487 bp, Homo sapiens; identical to SEQ ID NO: 537079
  misc_feature: HIJSMM301B2FSY.14.55.E11.1.454.light.4.raw

SEQ ID NO: 552125 - DNA, 492 bp, Homo sapiens; identical to SEQ ID NO: 545637
  misc_feature: HIJSMM301C5J5D.48.1.A01.1.454.light.4.raw

SEQ ID NO: 552126 - DNA, 447 bp, Homo sapiens
  misc_feature: HIJSMM301DQNQK.5.9.A09.1.454.light.4.raw
atcagacacgcacgaccggtgctcgatttagcgagacgcgcagggtccgtgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaaagtcagcccaaggctgccccctcgggtcactctgttcccaccctcctccgtgtctgat

SEQ ID NO: 552127 - DNA, 488 bp, Homo sapiens
  misc_feature: HIJSMM301BZ6IC.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctcgggacgtaaggtggaggatcagacgaactgtggctgcaccatctgtcttcta

SEQ ID NO: 552128 - DNA, 516 bp, Homo sapiens
  misc_feature: HIJSMM301E3CS8.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggtcggagggaccaagctgaccgtcctgggtcgagcccaacggctgccccctccggtcactcctgttcccaccct

SEQ ID NO: 552129 - DNA, 516 bp, Homo sapiens
  misc_feature: HIJSMM301DQD8L.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccc

SEQ ID NO: 552130 - DNA, 496 bp, Homo sapiens; identical to SEQ ID NO: 548177
  misc_feature: HIJSMM301BKC63.18.59.F04.1.454.light.4.raw

SEQ ID NO: 552131 - DNA, 447 bp, Homo sapiens; identical to SEQ ID NO: 535201
  misc_feature: HIJSMM301EKXG2.18.9.A09.1.454.light.4.raw

SEQ ID NO: 552132 - DNA, 485 bp, Homo sapiens
  misc_feature: HIJSMM301BE8O1.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggacaaactggacatcaaacgaactgtgctgcaccatctgt

SEQ ID NO: 552133 - DNA, 491 bp, Homo sapiens
  misc_feature: HIJSMM301DE44Z.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccgaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcggccaaggaccaaggtggagtacaacgaactgtggctgcaccatctgtctt

SEQ ID NO: 552134 - DNA, 503 bp, Homo sapiens
  misc_feature: HIJSMM301EEKQC.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 552135 - DNA, 494 bp, Homo sapiens; identical to SEQ ID NO: 535629
  misc_feature: HIJSMM301BIZUF.4.27.C05.1.454.light.4.raw

SEQ ID NO: 552136 - DNA, 509 bp, Homo sapiens; identical to SEQ ID NO: 539359
  misc_feature: HIJSMM301AIKDF.47.85.H08.1.454.light.4.raw

SEQ ID NO: 552137 - DNA, 486 bp, Homo sapiens; identical to SEQ ID NO: 535043
  misc_feature: HIJSMM301CR4BW.46.35.D02.1.454.light.4.raw

SEQ ID NO: 552138 - DNA, 517 bp, Homo sapiens; identical to SEQ ID NO: 537838
  misc_feature: HIJSMM301A39US.7.86.H09.1.454.light.4.raw

SEQ ID NO: 552139 - DNA, 500 bp, Homo sapiens
  misc_feature: HIJSMM301DREBU.40.38.D05.1.454.light.4.raw
tctagcgactcacgaccggtgctcgatttagtatctgatagttgggtttgggggggtctcaggaggcagcactctcgggacgtctccaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccctcggtcac

SEQ ID NO: 552140 - DNA, 499 bp, Homo sapiens
  misc_feature: HIJSMM301EXIB9.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccgaaggtggagaatcaaacgaaactgtggctgcaccatctgtcttcatcttcccg

SEQ ID NO: 552141 - DNA, 512 bp, Homo sapiens
  misc_feature: HIJSMM301EULS2.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcatgagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccgaggtgaccgtcctacgtcagcccaac

SEQ ID NO: 552142 - DNA, 503 bp, Homo sapiens; identical to SEQ ID NO: 536834
  misc_feature: HIJSMM301DA1T0.2.35.D02.1.454.light.4.raw

SEQ ID NO: 552143 - DNA, 493 bp, Homo sapiens; identical to SEQ ID NO: 544335
  misc_feature: HIJSMM301CUM1H.5.57.F02.1.454.light.4.raw

SEQ ID NO: 552144 - DNA, 500 bp, Homo sapiens; identical to SEQ ID NO: 535310
  misc_feature: HIJSMM301BR3HK.47.66.F11.1.454.light.4.raw

SEQ ID NO: 552145 - DNA, 488 bp, Homo sapiens; identical to SEQ ID NO: 535990
  misc_feature: HIJSMM301B8JI1.11.28.C06.1.454.light.4.raw

SEQ ID NO: 552146 - DNA, 490 bp, Homo sapiens
  misc_feature: HIJSMM301E0JEK.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 552147 - DNA, 447 bp, Homo sapiens; identical to SEQ ID NO: 535020
  misc_feature: HIJSMM301D2II7.18.9.A09.1.454.light.4.raw

SEQ ID NO: 552148 - DNA, 479 bp, Homo sapiens; identical to SEQ ID NO: 535665
  misc_feature: HIJSMM301CW18R.12.10.A10.1.454.light.4.raw

SEQ ID NO: 552149 - DNA, 502 bp, Homo sapiens
  misc_feature: HIJSMM301EJNDJ.48.25.C03.1.454.light.4.raw
agtatacatacacgaccggtgctcgatttagtagtgtagatttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccg

SEQ ID NO: 552150 - DNA, 512 bp, Homo sapiens
  misc_feature: HIJSMM301D3RZC.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctcct

SEQ ID NO: 552151 - DNA, 519 bp, Homo sapiens; identical to SEQ ID NO: 544656
  misc_feature: HIJSMM301DGL0W.27.23.C01.1.454.light.4.raw

SEQ ID NO: 552152 - DNA, 488 bp, Homo sapiens
  misc_feature: HIJSMM301EKRKU.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtctaggtcagcccaaggctgccccctcggtcact

SEQ ID NO: 552153 - DNA, 514 bp, Homo sapiens
  misc_feature: HIJSMM301A2AJD.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccaccctcct

SEQ ID NO: 552154 - DNA, 464 bp, Homo sapiens; identical to SEQ ID NO: 536640
  misc_feature: HIJSMM301DCYWE.26.78.H01.1.454.light.4.raw

SEQ ID NO: 552155 - DNA, 507 bp, Homo sapiens; identical to SEQ ID NO: 536666
  misc_feature: HIJSMM301BGAR3.11.57.F02.1.454.light.4.raw

SEQ ID NO: 552156 - DNA, 486 bp, Homo sapiens
  misc_feature: HIJSMM301DQQCN.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatggggatagtagcctgagtagtgtggttttcggcggagggaccaaactgaccgtcctaggtcagcccaaggctgccccctcggtcactctgttcccaccctcctctacgtgagct

SEQ ID NO: 552157 - DNA, 490 bp, Homo sapiens
  misc_feature: HIJSMM301D16LL.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaaacagtatcatcatcattgtaatttcggtggagggacaaggtggaggtcaaacgaactgtggctgcaccatctgtcttcat

SEQ ID NO: 552158 - DNA, 511 bp, Homo sapiens
  misc_feature: HIJSMM301BKOI8.12.53.E09.1.454.light.4.raw
atacgacgtacacgaccggtgctcgatttagagagagtgtgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtc

SEQ ID NO: 552159 - DNA, 487 bp, Homo sapiens
  misc_feature: HIJSMM301BLINS.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaactcctcatctctactgcatccactttgcaaagtgggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 552160 - DNA, 507 bp, Homo sapiens
  misc_feature: HIJSMM301DA5QJ.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtctaagtcagcccaaggctgccccctcggtcactctgtt

SEQ ID NO: 552161 - DNA, 465 bp, Homo sapiens; identical to SEQ ID NO: 538589
  misc_feature: HIJSMM301B46XW.12.39.D06.1.454.light.4.raw

SEQ ID NO: 552162 - DNA, 486 bp, Homo sapiens; identical to SEQ ID NO: 535054
  misc_feature: HIJSMM301ELFIQ.47.70.G04.1.454.light.4.raw

SEQ ID NO: 552163 - DNA, 469 bp, Homo sapiens; identical to SEQ ID NO: 536091
  misc_feature: HIJSMM301A9B14.3.82.H05.1.454.light.4.raw

SEQ ID NO: 552164 - DNA, 447 bp, Homo sapiens
  misc_feature: HIJSMM301D8ND7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccgacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 552165 - DNA, 448 bp, Homo sapiens
  misc_feature: HIJSMM301BWQFH.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 552166 - DNA, 483 bp, Homo sapiens; identical to SEQ ID NO: 535413
  misc_feature: HIJSMM301DJYUU.26.78.H01.1.454.light.4.raw

SEQ ID NO: 552167 - DNA, 478 bp, Homo sapiens
  misc_feature: HIJSMM301C64GD.49.73.G07.1.454.light.4.raw
agtcgagagacacgaccggtgctcgatttagctctacgctcagggcacgaccggtgctcgatttagctctacgctcagggcacgaccggtgctcgatttagagagagtgtgttgggtttggggggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtc

SEQ ID NO: 552168 - DNA, 486 bp, Homo sapiens; identical to SEQ ID NO: 535385
  misc_feature: HIJSMM301CH3LF.19.71.G05.1.454.light.4.raw

SEQ ID NO: 552169 - DNA, 510 bp, Homo sapiens
  misc_feature: HIJSMM301D7JWI.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaataagaggtacgaaacgaaactagtggctgcaccaatctgtcttcatt

SEQ ID NO: 552170 - DNA, 485 bp, Homo sapiens; identical to SEQ ID NO: 536263
  misc_feature: HIJSMM301AFFQH.47.78.H01.1.454.light.4.raw

SEQ ID NO: 552171 - DNA, 506 bp, Homo sapiens; identical to SEQ ID NO: 534969
  misc_feature: HIJSMM301ED8S1.18.37.D04.1.454.light.4.raw

SEQ ID NO: 552172 - DNA, 472 bp, Homo sapiens; identical to SEQ ID NO: 541249
  misc_feature: HIJSMM301DAOCH.5.28.C06.1.454.light.4.raw

SEQ ID NO: 552173 - DNA, 485 bp, Homo sapiens
  misc_feature: HIJSMM301EA9XC.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 552174 - DNA, 490 bp, Homo sapiens
  misc_feature: HIJSMM301A4BVK.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagtctggtatcaacagaaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 552175 - DNA, 441 bp, Homo sapiens; identical to SEQ ID NO: 534971
  misc_feature: HIJSMM301BOVZB.11.3.A03.1.454.light.4.raw

SEQ ID NO: 552176 - DNA, 484 bp, Homo sapiens
  misc_feature: HIJSMM301C7OAN.40.83.H06.1.454.light.4.raw
tctagcgactcacgaccggtgctcgatttagatcacgtgcgtcgcgggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacg

SEQ ID NO: 552177 - DNA, 447 bp, Homo sapiens
  misc_feature: HIJSMM301EAXG7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactttgttcccgccctcctccatactcgta

SEQ ID NO: 552178 - DNA, 499 bp, Homo sapiens
  misc_feature: HIJSMM301EUIUB.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaa

SEQ ID NO: 552179 - DNA, 493 bp, Homo sapiens; identical to SEQ ID NO: 535047
  misc_feature: HIJSMM301DGO53.16.53.E09.1.454.light.4.raw

SEQ ID NO: 552180 - DNA, 494 bp, Homo sapiens
  misc_feature: HIJSMM301CMB37.49.41.D08.1.454.light.4.raw
agtcgagagacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 552181 - DNA, 483 bp, Homo sapiens; identical to SEQ ID NO: 536836
  misc_feature: HIJSMM301AUH84.3.38.D05.1.454.light.4.raw

SEQ ID NO: 552182 - DNA, 490 bp, Homo sapiens; identical to SEQ ID NO: 535420
  misc_feature: HIJSMM301DM4JL.3.72.G06.1.454.light.4.raw

SEQ ID NO: 552183 - DNA, 491 bp, Homo sapiens; identical to SEQ ID NO: 536988
  misc_feature: HIJSMM301D4SKS.17.21.B10.1.454.light.4.raw

SEQ ID NO: 552184 - DNA, 479 bp, Homo sapiens; identical to SEQ ID NO: 535188
  misc_feature: HIJSMM301B2DAS.10.74.G08.1.454.light.4.raw

SEQ ID NO: 552185 - DNA, 484 bp, Homo sapiens; identical to SEQ ID NO: 535400
  misc_feature: HIJSMM301DHQAP.46.26.C04.1.454.light.4.raw

SEQ ID NO: 552186 - DNA, 494 bp, Homo sapiens
  misc_feature: HIJSMM301D64B3.40.9.A09.1.454.light.4.raw
tctagcgactcacgaccggtgctcgatttagcgagacgcgcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaagcgaactgtggctgcaccatctgtcttcatcttcccgcc

SEQ ID NO: 552187 - DNA, 444 bp, Homo sapiens; identical to SEQ ID NO: 535594
  misc_feature: HIJSMM301AIXYF.9.9.A09.1.454.light.4.raw

SEQ ID NO: 552188 - DNA, 503 bp, Homo sapiens
  misc_feature: HIJSMM301AUJS8.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatggtggctagtttattactgtcagcagtattatactactcctctgacgttcggccaagggaccaaggtggagactacaaacgaactgtggctgcaccatcttcg

SEQ ID NO: 552189 - DNA, 496 bp, Homo sapiens; identical to SEQ ID NO: 536802
  misc_feature: HIJSMM301BWCBD.5.24.C02.1.454.light.4.raw

SEQ ID NO: 552190 - DNA, 518 bp, Homo sapiens; identical to SEQ ID NO: 542842
  misc_feature: HIJSMM301BP2AQ.8.87.H10.1.454.light.4.raw

SEQ ID NO: 552191 - DNA, 495 bp, Homo sapiens; identical to SEQ ID NO: 535007
  misc_feature: HIJSMM301AHNCZ.22.5.A05.1.454.light.4.raw

SEQ ID NO: 552192 - DNA, 502 bp, Homo sapiens
  misc_feature: HIJSMM301AX37Y.48.30.C08.1.454.light.4.raw
agtatacatacacgaccggtgctcgatttagtctgacgtcaaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggtctgcaccatctgtcttcatcttcccg

SEQ ID NO: 552193 - DNA, 512 bp, Homo sapiens; identical to SEQ ID NO: 540108
  misc_feature: HIJSMM301D0C2Q.40.12.B01.1.454.light.4.raw

SEQ ID NO: 552194 - DNA, 497 bp, Homo sapiens
  misc_feature: HIJSMM301CTCAS.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctc

SEQ ID NO: 552195 - DNA, 492 bp, Homo sapiens; identical to SEQ ID NO: 536733
  misc_feature: HIJSMM301A0NE6.40.11.A11.1.454.light.4.raw

SEQ ID NO: 552196 - DNA, 467 bp, Homo sapiens
  misc_feature: HIJSMM301BARXR.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataac

SEQ ID NO: 552197 - DNA, 500 bp, Homo sapiens
  misc_feature: HIJSMM301D8HCS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactcaccttcggtccaacggacgacgactggaggattaaacgaaacctgtggcgtgcgaccactctgtcttcatt

SEQ ID NO: 552198 - DNA, 484 bp, Homo sapiens; identical to SEQ ID NO: 535441
  misc_feature: HIJSMM301B1BPR.26.60.F05.1.454.light.4.raw

SEQ ID NO: 552199 - DNA, 487 bp, Homo sapiens
  misc_feature: HIJSMM301CGGWB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaaa

SEQ ID NO: 552200 - DNA, 448 bp, Homo sapiens
  misc_feature: HIJSMM301ADP6T.18.9.A09.1.454.light.4.raw
  modified_base (430)..(430): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactaggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatactcgta

SEQ ID NO: 552201 - DNA, 505 bp, Homo sapiens
  misc_feature: HIJSMM301ADU7S.11.71.G05.1.454.light.4.raw
cgagagataccacgaccggtgctcgatttagtgtcgtcgcaagagagaggggggaggaactgctcagttaggacccacgagggaaccatggaagccccacgctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtggggtctgggacagacttcactctcaccatcagcagcctagagcctgaggattttgtcagtttattactgtcagcagcgtatcgactggatcaccttcggtccaacgggacgacgactggaaagttaaacgtaaactagtggcgtgcaccactctgttcttc

SEQ ID NO: 552202 - DNA, 490 bp, Homo sapiens; identical to SEQ ID NO: 541141
  misc_feature: HIJSMM301ETV3J.47.38.D05.1.454.light.4.raw

SEQ ID NO: 552203 - DNA, 502 bp, Homo sapiens; identical to SEQ ID NO: 535463
  misc_feature: HIJSMM301ER6ZY.43.86.H09.1.454.light.4.raw

SEQ ID NO: 552204 - DNA, 489 bp, Homo sapiens
  misc_feature: HIJSMM301ET5EU.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggaggaccgaggtaggagatacaaacgaactc

SEQ ID NO: 552205 - DNA, 490 bp, Homo sapiens; identical to SEQ ID NO: 535936
  misc_feature: HIJSMM301CI3LM.16.68.G02.1.454.light.4.raw

SEQ ID NO: 552206 - DNA, 494 bp, Homo sapiens; identical to SEQ ID NO: 536974
  misc_feature: HIJSMM301ANWRL.16.86.H09.1.454.light.4.raw

SEQ ID NO: 552207 - DNA, 476 bp, Homo sapiens
  misc_feature: HIJSMM301AHXN3.48.70.G04.1.454.light.4.raw
  modified_base (440)..(440): a, c, t, g, unknown or other
agtatacatacacgaccggtgctcgatttagtgtagtgtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactnttatgtcttcggaactgagaccaaggtcaccgtcct

SEQ ID NO: 552208 - DNA, 494 bp, Homo sapiens; identical to SEQ ID NO: 534992
  misc_feature: HIJSMM301CRVBT.9.1.A01.1.454.light.4.raw

SEQ ID NO: 552209 - DNA, 508 bp, Homo sapiens
  misc_feature: HIJSMM301CUI3Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggaccgaaggtaggaaatcaaacgaaactgtggctgcaccatctgtcttcatcttccccg

SEQ ID NO: 552210 - DNA, 510 bp, Homo sapiens
  misc_feature: HIJSMM301D2NBN.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatcaaacgaaactgtggctgcaccatctgtctt

SEQ ID NO: 552211 - DNA, 516 bp, Homo sapiens; identical to SEQ ID NO: 544947
  misc_feature: HIJSMM301CLMAK.48.61.F06.1.454.light.4.raw

SEQ ID NO: 552212 - DNA, 491 bp, Homo sapiens; identical to SEQ ID NO: 535294
  misc_feature: HIJSMM301ARJ2X.16.68.G02.1.454.light.4.raw

SEQ ID NO: 552213 - DNA, 489 bp, Homo sapiens
  misc_feature: HIJSMM301B90OS.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaaagttgagatcaaacgaactgtggctgcaccatctgtt

SEQ ID NO: 552214 - DNA, 510 bp, Homo sapiens
  misc_feature: HIJSMM301ED34H.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtcggaaatcaaacgaactgtggctgcaccatctgtctt

SEQ ID NO: 552215 - DNA, 503 bp, Homo sapiens
  misc_feature: HIJSMM301BEO5Y.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggtccggggaccgaccgtaggaatacaaacgaacctagtggctgcga

SEQ ID NO: 552216 - DNA, 502 bp, Homo sapiens
  misc_feature: HIJSMM301ADUJ1.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactagtggctgcaccat

SEQ ID NO: 552217 - DNA, 484 bp, Homo sapiens; identical to SEQ ID NO: 535400
  misc_feature: HIJSMM301EQ9MG.46.26.C04.1.454.light.4.raw

SEQ ID NO: 552218 - DNA, 419 bp, Homo sapiens
  misc_feature: HIJSMM301DGULB.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttccccaccctcctccatacctcgta

SEQ ID NO: 552219 - DNA, 522 bp, Homo sapiens; identical to SEQ ID NO: 543470
  misc_feature: HIJSMM301EQ8KG.5.27.C05.1.454.light.4.raw

SEQ ID NO: 552220 - DNA, 463 bp, Homo sapiens
  misc_feature: HIJSMM301B32RX.18.59.F04.1.454.light.4.raw
tacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 552221 - DNA, 484 bp, Homo sapiens
  misc_feature: HIJSMM301D2MV8.4.2.A02.1.454.light.4.raw
agcactgtagcacgaccggtgctcgatttagactcatctacaggggagtctcagtcaagacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggaggaccaaggtggagatcaaacgaactgtggctgcaccatctgtcttcta

SEQ ID NO: 552222 - DNA, 502 bp, Homo sapiens
  misc_feature: HIJSMM301A93T9.43.33.C11.1.454.light.4.raw
tgtgagtagtcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccttccacccttgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaacgggaccaaccgtaggaaatacaaacgaactagtggctgcaccatctgtcttctatt

SEQ ID NO: 552223 - DNA, 506 bp, Homo sapiens
  misc_feature: HIJSMM301AQXJY.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctccttcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaagtggatatcaaacgaactgtggctgcaccatctgtcttcatt

SEQ ID NO: 552224 - DNA, 512 bp, Homo sapiens
  misc_feature: HIJSMM301CGZSZ.17.33.C11.1.454.light.4.raw
  modified_base (426)..(426): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggnggtgctgtgctattcggcggagggccaagctgaccgtcttaagtcagcccaaggctgccccctggtcactctgttcccaccctcct

SEQ ID NO: 552225 - DNA, 495 bp, Homo sapiens
  misc_feature: HIJSMM301BNRJY.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaaggtggagatcaaacgaactgtggctgcaccat

SEQ ID NO: 552226 - DNA, 508 bp, Homo sapiens; identical to SEQ ID NO: 540739
  misc_feature: HIJSMM301AFI34.14.7.A07.1.454.light.4.raw

SEQ ID NO: 552227 - DNA, 491 bp, Homo sapiens
  misc_feature: HIJSMM301A04FA.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtgatatcaggcgaactgtggctgcaccatctgtctt

SEQ ID NO: 552228 - DNA, 421 bp, Homo sapiens
  misc_feature: HIJSMM301D161Z.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 552229 - DNA, 488 bp, Homo sapiens; identical to SEQ ID NO: 537673
  misc_feature: HIJSMM301AJGZ5.12.31.C09.1.454.light.4.raw

SEQ ID NO: 552230 - DNA, 490 bp, Homo sapiens; identical to SEQ ID NO: 551475
  misc_feature: HIJSMM301EMA9U.51.71.G05.1.454.light.4.raw

SEQ ID NO: 552231 - DNA, 502 bp, Homo sapiens; identical to SEQ ID NO: 536604
  misc_feature: HIJSMM301B8E73.27.78.H01.1.454.light.4.raw

SEQ ID NO: 552232 - DNA, 503 bp, Homo sapiens; identical to SEQ ID NO: 537189
  misc_feature: HIJSMM301AXVVL.19.85.H08.1.454.light.4.raw

SEQ ID NO: 552233 - DNA, 503 bp, Homo sapiens; identical to SEQ ID NO: 541454
  misc_feature: HIJSMM301DHVG1.9.12.B01.1.454.light.4.raw

SEQ ID NO: 552234 - DNA, 504 bp, Homo sapiens
  misc_feature: HIJSMM301BVF83.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctggtcactctcg

SEQ ID NO: 552235 - DNA, 497 bp, Homo sapiens
  misc_feature: HIJSMM301DE5YM.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctcggtcactctgttcccaccctcct

SEQ ID NO: 552236 - DNA, 491 bp, Homo sapiens; identical to SEQ ID NO: 548535
  misc_feature: HIJSMM301BHTNE.51.71.G05.1.454.light.4.raw

SEQ ID NO: 552237 - DNA, 521 bp, Homo sapiens; identical to SEQ ID NO: 538715
  misc_feature: HIJSMM301DVCJ1.27.23.C01.1.454.light.4.raw

SEQ ID NO: 552238 - DNA, 490 bp, Homo sapiens; identical to SEQ ID NO: 535234
  misc_feature: HIJSMM301AHVIK.17.21.B10.1.454.light.4.raw

SEQ ID NO: 552239 - DNA, 488 bp, Homo sapiens; identical to SEQ ID NO: 538017
  misc_feature: HIJSMM301C8Z17.4.59.F04.1.454.light.4.raw

SEQ ID NO: 552240 - DNA, 501 bp, Homo sapiens; identical to SEQ ID NO: 535746
  misc_feature: HIJSMM301DIZQK.18.11.A11.1.454.light.4.raw

SEQ ID NO: 552241 - DNA, 505 bp, Homo sapiens; identical to SEQ ID NO: 535503
  misc_feature: HIJSMM301CFQQB.8.28.C06.1.454.light.4.raw

SEQ ID NO: 552242 - DNA, 496 bp, Homo sapiens; identical to SEQ ID NO: 537925
  misc_feature: HIJSMM301CVTTK.22.14.B03.1.454.light.4.raw

SEQ ID NO: 552243 - DNA, 504 bp, Homo sapiens; identical to SEQ ID NO: 536300
  misc_feature: HIJSMM301CH73H.40.9.A09.1.454.light.4.raw

SEQ ID NO: 552244 - DNA, 483 bp, Homo sapiens; identical to SEQ ID NO: 539682
  misc_feature: HIJSMM301BRIQY.49.28.C06.1.454.light.4.raw

SEQ ID NO: 552245 - DNA, 489 bp, Homo sapiens
  misc_feature: HIJSMM301AFX39.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggatttttgcaacttattactgccagcagtataatgattaccctatcaccttcggccgggggacgacggctggaaactaaacgaaactgtggctgcacca

SEQ ID NO: 552246 - DNA, 504 bp, Homo sapiens
  misc_feature: HIJSMM301BYRY1.21.22.B11.1.454.light.4.raw
tcgtcgctcgcacgaccggtgctcgatttagacgacagctcagggtggggtcaaaaacccggggagggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactatta

SEQ ID NO: 552247 - DNA, 501 bp, Homo sapiens
  misc_feature: HIJSMM301BPHAF.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgtacggtcggaggaccgaccagtcgacgatacaaacgaaactacgtggcgtcgtcgaccactcttcg

SEQ ID NO: 552248 - DNA, 505 bp, Homo sapiens
  misc_feature: HIJSMM301AS3Z9.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcact

SEQ ID NO: 552249 - DNA, 483 bp, Homo sapiens; identical to SEQ ID NO: 545893
  misc_feature: HIJSMM301DDJ3Z.3.38.D05.1.454.light.4.raw

SEQ ID NO: 552250 - DNA, 477 bp, Homo sapiens; identical to SEQ ID NO: 537453
  misc_feature: HIJSMM301CWE2D.8.85.H08.1.454.light.4.raw

SEQ ID NO: 552251 - DNA, 498 bp, Homo sapiens
  misc_feature: HIJSMM301EJ2KV.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 552252 - DNA, 484 bp, Homo sapiens; identical to SEQ ID NO: 536395
  misc_feature: HIJSMM301A2TRA.46.35.D02.1.454.light.4.raw

SEQ ID NO: 552253 - DNA, 493 bp, Homo sapiens
  misc_feature: HIJSMM301B0ZQJ.48.78.H01.1.454.light.4.raw
agtatacatacacgaccggtgctcgatttagtgtgagtagtttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaaggctgacagtcctaggtcagcccaaggctgccccctc

SEQ ID NO: 552254 - DNA, 505 bp, Homo sapiens; identical to SEQ ID NO: 550409
  misc_feature: HIJSMM301BCFZW.48.53.E09.1.454.light.4.raw

SEQ ID NO: 552255 - DNA, 499 bp, Homo sapiens
  misc_feature: HIJSMM301CWRW2.10.17.B06.1.454.light.4.raw
catagtagtgcacgaccggtgctcgatttagtcgatagtgaagggggaggaactgctcagttaggacccagacggaaccatggaagccccagcgcagcttctcttcctcctactactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatcttccccg

SEQ ID NO: 552256 - DNA, 479 bp, Homo sapiens; identical to SEQ ID NO: 535118
  misc_feature: HIJSMM301EDA6E.13.59.F04.1.454.light.4.raw

SEQ ID NO: 552257 - DNA, 495 bp, Homo sapiens; identical to SEQ ID NO: 543626
  misc_feature: HIJSMM301EBGV8.40.71.G05.1.454.light.4.raw

SEQ ID NO: 552258 - DNA, 496 bp, Homo sapiens
  misc_feature: HIJSMM301A3O70.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgcccc

SEQ ID NO: 552259 - DNA, 497 bp, Homo sapiens; identical to SEQ ID NO: 536371
  misc_feature: HIJSMM301B1NL6.16.78.H01.1.454.light.4.raw

SEQ ID NO: 552260 - DNA, 508 bp, Homo sapiens
  misc_feature: HIJSMM301AXHRO.22.46.E02.1.454.light.4.raw
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctcggtcactc

SEQ ID NO: 552261 - DNA, 506 bp, Homo sapiens
  misc_feature: HIJSMM301CKTRK.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtcccgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 552262 - DNA, 483 bp, Homo sapiens; identical to SEQ ID NO: 544786
  misc_feature: HIJSMM301DPT0R.46.26.C04.1.454.light.4.raw

SEQ ID NO: 552263 - DNA, 468 bp, Homo sapiens
  misc_feature: HIJSMM301CXCK7.49.28.C06.1.454.light.4.raw
agtcgagagacacgaccggtgctcgatttagagctcacgtattgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgatttgcaacttattattgtcaacagagttacagtatcccgtacacttttggccaggggaccaggctggatatcagacgaa

SEQ ID NO: 552264 - DNA, 502 bp, Homo sapiens
  misc_feature: HIJSMM301BBQIX.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggcgctcactttcggcggaggaccaaggtggagatcaaacgaactgtggctgcacatctgt

SEQ ID NO: 552265 - DNA, 447 bp, Homo sapiens; identical to SEQ ID NO: 535201
  misc_feature: HIJSMM301DH15P.18.9.A09.1.454.light.4.raw

SEQ ID NO: 552266 - DNA, 505 bp, Homo sapiens
  misc_feature: HIJSMM301DME6O.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcgggttgggtgttcggcggagggaccaaacgtgaccgtcctaggtcagcccaa

SEQ ID NO: 552267 - DNA, 473 bp, Homo sapiens
  misc_feature: HIJSMM301D9ARF.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaaa

SEQ ID NO: 552268 - DNA, 539 bp, Homo sapiens
  misc_feature: HIJSMM301C49NS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaaggacggaaggtacgaaacgaaaccgtaacgtaggtacgtcgtcgaccaactctcgtcttctacttcttcccgtccctacctcctcgtat

SEQ ID NO: 552269 - DNA, 494 bp, Homo sapiens; identical to SEQ ID NO: 535276
  misc_feature: HIJSMM301AMSXX.16.6.A06.1.454.light.4.raw

SEQ ID NO: 552270 - DNA, 494 bp, Homo sapiens
  misc_feature: HIJSMM301DDW50.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatt

SEQ ID NO: 552271 - DNA, 505 bp, Homo sapiens; identical to SEQ ID NO: 542750
  misc_feature: HIJSMM301B8CIV.10.82.H05.1.454.light.4.raw

SEQ ID NO: 552272 - DNA, 494 bp, Homo sapiens; identical to SEQ ID NO: 535629
  misc_feature: HIJSMM301DVA1F.4.27.C05.1.454.light.4.raw

SEQ ID NO: 552273 - DNA, 495 bp, Homo sapiens
  misc_feature: HIJSMM301C13M7.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcaccgtccaaggtcacg

SEQ ID NO: 552274 - DNA, 489 bp, Homo sapiens; identical to SEQ ID NO: 535139
  misc_feature: HIJSMM301D4HQC.14.55.E11.1.454.light.4.raw

SEQ ID NO: 552275 - DNA, 485 bp, Homo sapiens; identical to SEQ ID NO: 535501
  misc_feature: HIJSMM301B1PXG.3.10.A10.1.454.light.4.raw

SEQ ID NO: 552276 - DNA, 519 bp, Homo sapiens
  misc_feature: HIJSMM301CA9FY.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccgaaggtgaccgtcctaagtcagccaaggctgccccctcggtcactctgttcccgccct

SEQ ID NO: 552277 - DNA, 454 bp, Homo sapiens; identical to SEQ ID NO: 534964
  misc_feature: HIJSMM301BOU1P.19.86.H09.1.454.light.4.raw

SEQ ID NO: 552278 - DNA, 422 bp, Homo sapiens; identical to SEQ ID NO: 539618
  misc_feature: HIJSMM301CYZSC.41.14.B03.1.454.light.4.raw

SEQ ID NO: 552279 - DNA, 486 bp, Homo sapiens; identical to SEQ ID NO: 535458
  misc_feature: HIJSMM301BHZOO.7.75.G09.1.454.light.4.raw

SEQ ID NO: 552280 - DNA, 485 bp, Homo sapiens
  misc_feature: HIJSMM301C6GKQ.21.25.C03.1.454.light.4.raw
  modified_base (473)..(473): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggcttcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggnggcgggaccaag

SEQ ID NO: 552281 - DNA, 523 bp, Homo sapiens
  misc_feature: HIJSMM301C7WT2.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactgggcctccgtggacgttcggccaagggacccgggtggaaagtaaaacgaaactagtggctgcaccaatctgtcttctatcttccccg

SEQ ID NO: 552282 - DNA, 505 bp, Homo sapiens
  misc_feature: HIJSMM301B4XE2.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggaggatcagacgaactgtggctgcaccatctgtcttcatcttccccg

SEQ ID NO: 552283 - DNA, 495 bp, Homo sapiens; identical to SEQ ID NO: 543094
  misc_feature: HIJSMM301ATT3U.22.57.F02.1.454.light.4.raw

SEQ ID NO: 552284 - DNA, 496 bp, Homo sapiens
  misc_feature: HIJSMM301DJV1W.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtatgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 552285 - DNA, 497 bp, Homo sapiens; identical to SEQ ID NO: 534982
  misc_feature: HIJSMM301EJ5IH.26.80.H03.1.454.light.4.raw

SEQ ID NO: 552286 - DNA, 486 bp, Homo sapiens; identical to SEQ ID NO: 537127
  misc_feature: HIJSMM301BZYVQ.3.77.G11.1.454.light.4.raw

SEQ ID NO: 552287 - DNA, 514 bp, Homo sapiens
  misc_feature: HIJSMM301AI1L1.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 552288 - DNA, 489 bp, Homo sapiens; identical to SEQ ID NO: 535139
  misc_feature: HIJSMM301COUT1.14.55.E11.1.454.light.4.raw

SEQ ID NO: 552289 - DNA, 484 bp, Homo sapiens; identical to SEQ ID NO: 539003
  misc_feature: HIJSMM301BUGXE.10.1.A01.1.454.light.4.raw

SEQ ID NO: 552290 - DNA, 481 bp, Homo sapiens
  misc_feature: HIJSMM301A4FRH.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggaggatcaaacgaactagtggctgcacc

SEQ ID NO: 552291 - DNA, 496 bp, Homo sapiens; identical to SEQ ID NO: 540594
  misc_feature: HIJSMM301COF6G.4.59.F04.1.454.light.4.raw

SEQ ID NO: 552292 - DNA, 492 bp, Homo sapiens
  misc_feature: HIJSMM301CRUH1.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttacctccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaacc

SEQ ID NO: 552293 - DNA, 503 bp, Homo sapiens; identical to SEQ ID NO: 536435
  misc_feature: HIJSMM301CBOE8.21.22.B11.1.454.light.4.raw

SEQ ID NO: 552294 - DNA, 504 bp, Homo sapiens; identical to SEQ ID NO: 535495
  misc_feature: HIJSMM301EZY5R.14.86.H09.1.454.light.4.raw

SEQ ID NO: 552295 - DNA, 489 bp, Homo sapiens; identical to SEQ ID NO: 535139
  misc_feature: HIJSMM301AJWJU.14.55.E11.1.454.light.4.raw

SEQ ID NO: 552296 - DNA, 501 bp, Homo sapiens
  misc_feature: HIJSMM301AV4Q9.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggtcaggggaccaaggtggagatcagacgaactgtggctgcaccatctgtcttcatcttcccg

SEQ ID NO: 552297 - DNA, 404 bp, Homo sapiens; identical to SEQ ID NO: 535530
  misc_feature: HIJSMM301CMRUV.4.35.D02.1.454.light.4.raw

SEQ ID NO: 552298 - DNA, 491 bp, Homo sapiens; identical to SEQ ID NO: 535194
  misc_feature: HIJSMM301A1JDN.26.78.H01.1.454.light.4.raw

SEQ ID NO: 552299 - DNA, 488 bp, Homo sapiens; identical to SEQ ID NO: 535125
  misc_feature: HIJSMM301B6888.17.25.C03.1.454.light.4.raw

SEQ ID NO: 552300 - DNA, 500 bp, Homo sapiens
  misc_feature: HIJSMM301EL195.53.30.C08.1.454.light.4.raw
cgcgtatacacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 552301 - DNA, 508 bp, Homo sapiens; identical to SEQ ID NO: 536388
  misc_feature: HIJSMM301CCKUO.11.57.F02.1.454.light.4.raw

SEQ ID NO: 552302 - DNA, 521 bp, Homo sapiens
  misc_feature: HIJSMM301BN2HK.41.53.E09.1.454.light.4.raw
tctatactatcacgaccggtgctcgatttagagagagtgtgttgggtttgggggggtcgtcaggaggcagcgctctcgggacgtctccaccatggcctggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtattggtcggagggaccaagctgaccgtcctggtcagcccaaggctgccccctcggtcactctgttcccgcct

SEQ ID NO: 552303 - DNA, 513 bp, Homo sapiens
  misc_feature: HIJSMM301DNCN0.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccactttcgcccgtcggaccgaaagtaggatatacaaacgaaactgtggcgtcgcaccatctcgtt

SEQ ID NO: 552304 - DNA, 485 bp, Homo sapiens
  misc_feature: HIJSMM301AJL1U.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaa

SEQ ID NO: 552305 - DNA, 444 bp, Homo sapiens
  misc_feature: HIJSMM301BD62H.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 552306 - DNA, 505 bp, Homo sapiens
  misc_feature: HIJSMM301A05J8.48.16.B05.1.454.light.4.raw
agtatacatacacgaccggtgctcgatttagagctcacgtaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggcggagggaccaaactgaccgtcctcggtcggcccaaggctgccccctcggtcactctcg

SEQ ID NO: 552307 - DNA, 508 bp, Homo sapiens
  misc_feature: HIJSMM301CVZ7M.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttcta

SEQ ID NO: 552308 - DNA, 491 bp, Homo sapiens
  misc_feature: HIJSMM301DQSQU.12.23.C01.1.454.light.4.raw
atacgacgtacacgaccggtgctcgatttagtacacgtgattagggattggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggaccgaagtggagatcaacgaactgtggcgtgcaccatctgtt

SEQ ID NO: 552309 - DNA, 492 bp, Homo sapiens
  misc_feature: HIJSMM301CAV7O.51.35.D02.1.454.light.4.raw
cgatcgtatacacgaccggtgctcgatttagcacacgatagttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctccggt

SEQ ID NO: 552310 - DNA, 503 bp, Homo sapiens; identical to SEQ ID NO: 538884
  misc_feature: HIJSMM301CI4R6.27.78.H01.1.454.light.4.raw

SEQ ID NO: 552311 - DNA, 506 bp, Homo sapiens
  misc_feature: HIJSMM301ANQHU.5.24.C02.1.454.light.4.raw
atcagacacgcacgaccggtgctcgatttagtacagatcgttagggaaaggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 552312 - DNA, 517 bp, Homo sapiens; identical to SEQ ID NO: 538938
  misc_feature: HIJSMM301AQEHD.7.86.H09.1.454.light.4.raw

SEQ ID NO: 552313 - DNA, 496 bp, Homo sapiens
  misc_feature: HIJSMM301ASKOG.40.37.D04.1.454.light.4.raw
tctagcgactcacgaccggtgctcgatttagtagcatactgttgggtttggggaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcgggtaccgacgagtggagtgtcaacgaactacgtggctcg

SEQ ID NO: 552314 - DNA, 506 bp, Homo sapiens
  misc_feature: HIJSMM301AZ1ED.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttgggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagccc

SEQ ID NO: 552315 - DNA, 478 bp, Homo sapiens; identical to SEQ ID NO: 541928
  misc_feature: HIJSMM301BWL0W.7.76.G10.1.454.light.4.raw

SEQ ID NO: 552316 - DNA, 494 bp, Homo sapiens
  misc_feature: HIJSMM301DDYCP.16.53.E09.1.454.light.4.raw
tgtactactccacgaccggtgctcgatttagagagagtgtgttggggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagctctacaaactccttactctttaggccgagggaccaagctggagatacaaacgaactgtgg

SEQ ID NO: 552317 - DNA, 517 bp, Homo sapiens; identical to SEQ ID NO: 538903
  misc_feature: HIJSMM301ELDVI.41.25.C03.1.454.light.4.raw

SEQ ID NO: 552318 - DNA, 503 bp, Homo sapiens
  misc_feature: HIJSMM301CZCUL.41.35.D02.1.454.light.4.raw
tctatactatcacgaccggtgctcgatttagcacacgatagttgggtttgggggtgctcgattagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaacgaaa

SEQ ID NO: 552319 - DNA, 494 bp, Homo sapiens; identical to SEQ ID NO: 539894
  misc_feature: HIJSMM301AY3BL.16.53.E09.1.454.light.4.raw

SEQ ID NO: 552320 - DNA, 504 bp, Homo sapiens; identical to SEQ ID NO: 551974
  misc_feature: HIJSMM301DSZT3.19.78.H01.1.454.light.4.raw

SEQ ID NO: 552321 - DNA, 493 bp, Homo sapiens; identical to SEQ ID NO: 535745
  misc_feature: HIJSMM301AG7IU.47.78.H01.1.454.light.4.raw

SEQ ID NO: 552322 - DNA, 480 bp, Homo sapiens; identical to SEQ ID NO: 535291
  misc_feature: HIJSMM301C5HO4.22.59.F04.1.454.light.4.raw

SEQ ID NO: 552323 - DNA, 509 bp, Homo sapiens; identical to SEQ ID NO: 543772
  misc_feature: HIJSMM301D6D06.2.21.B10.1.454.light.4.raw

SEQ ID NO: 552324 - DNA, 499 bp, Homo sapiens; identical to SEQ ID NO: 536187
  misc_feature: HIJSMM301BWJRN.11.67.G01.1.454.light.4.raw

SEQ ID NO: 552325 - DNA, 482 bp, Homo sapiens
  misc_feature: HIJSMM301CT4Q2.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagcttaatagttacccgctcagtttcggcggagggaccaaggtggagatcaaacgaactgtggctgcaccatctgtt

SEQ ID NO: 552326 - DNA, 485 bp, Homo sapiens; identical to SEQ ID NO: 546273
  misc_feature: HIJSMM301CUOFJ.43.36.D03.1.454.light.4.raw

SEQ ID NO: 552327 - DNA, 489 bp, Homo sapiens; identical to SEQ ID NO: 535139
  misc_feature: HIJSMM301BYHU8.14.55.E11.1.454.light.4.raw

SEQ ID NO: 552328 - DNA, 486 bp, Homo sapiens; identical to SEQ ID NO: 537310
  misc_feature: HIJSMM301APJXA.15.28.C06.1.454.light.4.raw

SEQ ID NO: 552329 - DNA, 491 bp, Homo sapiens
  misc_feature: HIJSMM301CGUDU.41.44.D11.1.454.light.4.raw
tctatactatcacgaccggtgctcgatttagcgcagtacgaagggggcgggggtaaggaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaaggctcg

SEQ ID NO: 552330 - DNA, 494 bp, Homo sapiens; identical to SEQ ID NO: 534992
  misc_feature: HIJSMM301BX7LD.9.1.A01.1.454.light.4.raw

SEQ ID NO: 552331 - DNA, 485 bp, Homo sapiens; identical to SEQ ID NO: 536263
  misc_feature: HIJSMM301CXJJ3.47.78.H01.1.454.light.4.raw

SEQ ID NO: 552332 - DNA, 484 bp, Homo sapiens; identical to SEQ ID NO: 535211
  misc_feature: HIJSMM301APDSO.47.46.E02.1.454.light.4.raw

SEQ ID NO: 552333 - DNA, 484 bp, Homo sapiens; identical to SEQ ID NO: 535441
  misc_feature: HIJSMM301BPNHQ.26.60.F05.1.454.light.4.raw

SEQ ID NO: 552334 - DNA, 492 bp, Homo sapiens
  misc_feature: HIJSMM301AV0A6.43.29.C07.1.454.light.4.raw
tgtgagtagtcacgaccggtgctcgatttagagtgctacgaagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgtcgaagacgaactacgtggcgtgcaccat

SEQ ID NO: 552335 - DNA, 502 bp, Homo sapiens
  misc_feature: HIJSMM301EHXR4.48.37.D04.1.454.light.4.raw
agtatacatacacgaccggtgctcgatttagtagcatactgttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaagggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 552336 - DNA, 516 bp, Homo sapiens; identical to SEQ ID NO: 536439
  misc_feature: HIJSMM301ET30K.14.66.F11.1.454.light.4.raw

SEQ ID NO: 552337 - DNA, 484 bp, Homo sapiens
  misc_feature: HIJSMM301C84YR.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaaggaccaaggtagaaatgaaacgaactgtgctgcaccat

SEQ ID NO: 552338 - DNA, 488 bp, Homo sapiens
  misc_feature: HIJSMM301BFAZJ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgctaatttattactgtcagcaatataatacctggcctccgctcactttcggcggaggaccaaggttgagatcaaacgaactgtggctgcacca

SEQ ID NO: 552339 - DNA, 496 bp, Homo sapiens; identical to SEQ ID NO: 538149
  misc_feature: HIJSMM301CNNIA.13.67.G01.1.454.light.4.raw

SEQ ID NO: 552340 - DNA, 494 bp, Homo sapiens; identical to SEQ ID NO: 535276
  misc_feature: HIJSMM301DEFAP.16.6.A06.1.454.light.4.raw

SEQ ID NO: 552341 - DNA, 519 bp, Homo sapiens
  misc_feature: HIJSMM301B7U54.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtaggcgaatcaaccgaactgtgctgcaccatctgtcttcatcttccccg

SEQ ID NO: 552342 - DNA, 493 bp, Homo sapiens; identical to SEQ ID NO: 535745
  misc_feature: HIJSMM301DSIPM.47.78.H01.1.454.light.4.raw

SEQ ID NO: 552343 - DNA, 472 bp, Homo sapiens; identical to SEQ ID NO: 535898
  misc_feature: HIJSMM301ER5LR.15.8.A08.1.454.light.4.raw

SEQ ID NO: 552344 - DNA, 454 bp, Homo sapiens
  misc_feature: HIJSMM301EIUDA.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggaagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 552345 - DNA, 473 bp, Homo sapiens
  misc_feature: HIJSMM301C6N4U.40.52.E08.1.454.light.4.raw
tctagcgactcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctcctgaccatctctgggctccaagctgaggacgaggctgtttatttctgcagctcatatacaagcagcaacactctggtgttcggcggagggaccaagctgaccgt

SEQ ID NO: 552346 - DNA, 490 bp, Homo sapiens; identical to SEQ ID NO: 537951
  misc_feature: HIJSMM301CKKQS.19.57.F02.1.454.light.4.raw

SEQ ID NO: 552347 - DNA, 499 bp, Homo sapiens
  misc_feature: HIJSMM301EBR6B.10.82.H05.1.454.light.4.raw
catagtagtgcacgaccggtgctcgatttagtcgagctctctcgcgggggctctgcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaac

SEQ ID NO: 552348 - DNA, 507 bp, Homo sapiens; identical to SEQ ID NO: 542822
  misc_feature: HIJSMM301EOOZP.40.26.C04.1.454.light.4.raw

SEQ ID NO: 552349 - DNA, 490 bp, Homo sapiens; identical to SEQ ID NO: 541141
  misc_feature: HIJSMM301A16JD.47.38.D05.1.454.light.4.raw

SEQ ID NO: 552350 - DNA, 501 bp, Homo sapiens
  misc_feature: HIJSMM301C1U8M.18.11.A11.1.454.light.4.raw
tacgagtatgcacgaccggtgctcgatttagctacgactgcagggggagcgtacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcacatctgtctt

SEQ ID NO: 552351 - DNA, 509 bp, Homo sapiens
  misc_feature: HIJSMM301BRAR2.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaaacagggtattcgggcggagggaccaagttgaccgtcctaggtcagcccaaggctgccccctggtcactctgttcccaccct

SEQ ID NO: 552352 - DNA, 466 bp, Homo sapiens
  misc_feature: HIJSMM301BCQ1G.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaaggtggagatgaagggaa

SEQ ID NO: 552353 - DNA, 495 bp, Homo sapiens; identical to SEQ ID NO: 535596
  misc_feature: HIJSMM301DALZF.10.79.H02.1.454.light.4.raw

SEQ ID NO: 552354 - DNA, 491 bp, Homo sapiens; identical to SEQ ID NO: 535194
  misc_feature: HIJSMM301CNR3X.26.78.H01.1.454.light.4.raw

SEQ ID NO: 552355 - DNA, 487 bp, Homo sapiens
  misc_feature: HIJSMM301DPG4V.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagatttgcaacttactactgtcaacagagttacagtacccccctcactttcggcggagggaccaaggcggagatcagacgaactgtggctgcaccatctgtcttca

SEQ ID NO: 552356 - DNA, 495 bp, Homo sapiens
  misc_feature: HIJSMM301AW9OH.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaaactgtggctgcaccatct

SEQ ID NO: 552357 - DNA, 511 bp, Homo sapiens
  misc_feature: HIJSMM301BA5CY.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggacaaggtggagtcaagcgaactgtggctgcgaccatctgtcttcactccttcccgtccact

SEQ ID NO: 552358 - DNA, 513 bp, Homo sapiens
  misc_feature: HIJSMM301ED5O9.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgccctcct

SEQ ID NO: 552359 - DNA, 489 bp, Homo sapiens; identical to SEQ ID NO: 535386
  misc_feature: HIJSMM301AR7NO.12.51.E07.1.454.light.4.raw

SEQ ID NO: 552360 - DNA, 494 bp, Homo sapiens; identical to SEQ ID NO: 535276
  misc_feature: HIJSMM301AKH36.16.6.A06.1.454.light.4.raw

SEQ ID NO: 552361 - DNA, 487 bp, Homo sapiens
  misc_feature: HIJSMM301AIOYC.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaatacaaacgaactagtggcgtgcaccata

SEQ ID NO: 552362 - DNA, 501 bp, Homo sapiens
  misc_feature: HIJSMM301CRKN2.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgtcggtccacgggaccgacacgtaggagtatacaggcgaactagtggcgtgcaccactctgtctt

SEQ ID NO: 552363 - DNA, 444 bp, Homo sapiens; identical to SEQ ID NO: 535192
  misc_feature: HIJSMM301B9EZC.5.9.A09.1.454.light.4.raw

SEQ ID NO: 552364 - DNA, 494 bp, Homo sapiens; identical to SEQ ID NO: 534994
  misc_feature: HIJSMM301D1P2Z.27.78.H01.1.454.light.4.raw

SEQ ID NO: 552365 - DNA, 519 bp, Homo sapiens
  misc_feature: HIJSMM301CEH34.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccgccct

SEQ ID NO: 552366 - DNA, 478 bp, Homo sapiens
  misc_feature: HIJSMM301BV682.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcacatct

SEQ ID NO: 552367 - DNA, 482 bp, Homo sapiens; identical to SEQ ID NO: 535216
  misc_feature: HIJSMM301BO122.17.26.C04.1.454.light.4.raw

SEQ ID NO: 552368 - DNA, 509 bp, Homo sapiens; identical to SEQ ID NO: 547302
  misc_feature: HIJSMM301AZOQF.4.57.F02.1.454.light.4.raw

SEQ ID NO: 552369 - DNA, 514 bp, Homo sapiens
  misc_feature: HIJSMM301AM6L8.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctccggtcactctgttcccaccctcct

SEQ ID NO: 552370 - DNA, 472 bp, Homo sapiens; identical to SEQ ID NO: 535992
  misc_feature: HIJSMM301BQ643.11.76.G10.1.454.light.4.raw

SEQ ID NO: 552371 - DNA, 502 bp, Homo sapiens
  misc_feature: HIJSMM301BJEUG.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgcccctcggtcactctgtt

SEQ ID NO: 552372 - DNA, 505 bp, Homo sapiens; identical to SEQ ID NO: 535987
  misc_feature: HIJSMM301EUY2H.18.37.D04.1.454.light.4.raw

SEQ ID NO: 552373 - DNA, 501 bp, Homo sapiens
  misc_feature: HIJSMM301EDOEV.13.19.B08.1.454.light.4.raw
tcacgtactacacgaccggtgctcgatttagtgagtcagtaaggggaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctgccccctcggtcactctgttcccgaccctcctct

SEQ ID NO: 552374 - DNA, 496 bp, Homo sapiens
  misc_feature: HIJSMM301AF4QU.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctccactttcggtcggagggaccgaaggtggagatcaagcgaacgtgtggctgcaccactctgtctt

SEQ ID NO: 552375 - DNA, 503 bp, Homo sapiens; identical to SEQ ID NO: 538884
  misc_feature: HIJSMM301A9E45.27.78.H01.1.454.light.4.raw

SEQ ID NO: 552376 - DNA, 494 bp, Homo sapiens; identical to SEQ ID NO: 534992
  misc_feature: HIJSMM301DAGI9.9.1.A01.1.454.light.4.raw

SEQ ID NO: 552377 - DNA, 486 bp, Homo sapiens
  misc_feature: HIJSMM301DYYYF.49.81.H04.1.454.light.4.raw
agtcgagagacacgaccggtgctcgatttagtagtgtagattcgcggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccatctgt

SEQ ID NO: 552378 - DNA, 503 bp, Homo sapiens; identical to SEQ ID NO: 541454
  misc_feature: HIJSMM301EG85H.9.12.B01.1.454.light.4.raw

SEQ ID NO: 552379 - DNA, 503 bp, Homo sapiens
  misc_feature: HIJSMM301CJT9L.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcagagggaccaaggtggaggatcaaacgaaactgtggctgcaccat

SEQ ID NO: 552380 - DNA, 524 bp, Homo sapiens
  misc_feature: HIJSMM301DJ8K2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgccctccc

SEQ ID NO: 552381 - DNA, 484 bp, Homo sapiens; identical to SEQ ID NO: 535240
  misc_feature: HIJSMM301EBZSC.47.60.F05.1.454.light.4.raw

SEQ ID NO: 552382 - DNA, 485 bp, Homo sapiens; identical to SEQ ID NO: 535501
  misc_feature: HIJSMM301BRG4U.3.10.A10.1.454.light.4.raw

SEQ ID NO: 552383 - DNA, 478 bp, Homo sapiens
  misc_feature: HIJSMM301AU7AN.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagccgggacccaggctatggatgaggctgactattactgtcaggcgtgggacagcagcactgcccgctatgtcttcggaactgggaccaaggtcaccgtcctaagtcagccccg

SEQ ID NO: 552384 - DNA, 477 bp, Homo sapiens
  misc_feature: HIJSMM301AQVOY.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgagtagtaca

SEQ ID NO: 552385 - DNA, 488 bp, Homo sapiens; identical to SEQ ID NO: 543314
  misc_feature: HIJSMM301A64RA.3.33.C11.1.454.light.4.raw

SEQ ID NO: 552386 - DNA, 493 bp, Homo sapiens; identical to SEQ ID NO: 535745
  misc_feature: HIJSMM301AM2T3.47.78.H01.1.454.light.4.raw

SEQ ID NO: 552387 - DNA, 499 bp, Homo sapiens; identical to SEQ ID NO: 543887
  misc_feature: HIJSMM301DBX6B.10.65.F10.1.454.light.4.raw

SEQ ID NO: 552388 - DNA, 486 bp, Homo sapiens
  misc_feature: HIJSMM301AOQG4.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacaactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagaccccg

SEQ ID NO: 552389 - DNA, 512 bp, Homo sapiens; identical to SEQ ID NO: 539813
  misc_feature: HIJSMM301EJBGY.14.7.A07.1.454.light.4.raw

SEQ ID NO: 552390 - DNA, 497 bp, Homo sapiens; identical to SEQ ID NO: 534982
  misc_feature: HIJSMM301CTNQP.26.80.H03.1.454.light.4.raw

SEQ ID NO: 552391 - DNA, 495 bp, Homo sapiens
  misc_feature: HIJSMM301C4RAS.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcac

SEQ ID NO: 552392 - DNA, 516 bp, Homo sapiens
  misc_feature: HIJSMM301ANZDD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccgaagggaccgaaggtaggaaagtactaaaacgaaacctagtggctgcaccatctgtcttctatcttccccg

SEQ ID NO: 552393 - DNA, 493 bp, Homo sapiens; identical to SEQ ID NO: 541606
  misc_feature: HIJSMM301A41N0.10.33.C11.1.454.light.4.raw

SEQ ID NO: 552394 - DNA, 513 bp, Homo sapiens
  misc_feature: HIJSMM301CJLQ5.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgtcccgcctcct

SEQ ID NO: 552395 - DNA, 506 bp, Homo sapiens
  misc_feature: HIJSMM301BIONW.14.57.F02.1.454.light.4.raw
cgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgccta

SEQ ID NO: 552396 - DNA, 445 bp, Homo sapiens; identical to SEQ ID NO: 537719
  misc_feature: HIJSMM301DXJ9A.47.85.H08.1.454.light.4.raw

SEQ ID NO: 552397 - DNA, 491 bp, Homo sapiens
  misc_feature: HIJSMM301DQ7S0.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagtagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttcggtccacgggaccgaacggtaggaaagtacaaacgaactagtggctgcaccatt

SEQ ID NO: 552398 - DNA, 504 bp, Homo sapiens
  misc_feature: HIJSMM301AV9LB.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctcgccccctcggtcacttc

SEQ ID NO: 552399 - DNA, 511 bp, Homo sapiens
  misc_feature: HIJSMM301A1KR3.8.23.C01.1.454.light.4.raw
ctcgcgtgtccacgaccggtgctcgatttagtacacgtgattagggattggggctgggcctcaggaagcagcatcgggggtgccgcagccatggcatggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtctaggtcagcccaaggccaaccccactgtcactctgttcccaccctcctcg

SEQ ID NO: 552400 - DNA, 503 bp, Homo sapiens
  misc_feature: HIJSMM301A0V9M.27.78.H01.1.454.light.4.raw
  modified_base (431)..(431): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcaccttcggccaagggacacgactggagattaaacg

SEQ ID NO: 552401 - DNA, 494 bp, Homo sapiens; identical to SEQ ID NO: 545180
  misc_feature: HIJSMM301A63B9.11.81.H04.1.454.light.4.raw

SEQ ID NO: 552402 - DNA, 441 bp, Homo sapiens; identical to SEQ ID NO: 535074
  misc_feature: HIJSMM301EW8XK.11.3.A03.1.454.light.4.raw

SEQ ID NO: 552403 - DNA, 511 bp, Homo sapiens; identical to SEQ ID NO: 548439
  misc_feature: HIJSMM301A7X3B.16.46.E02.1.454.light.4.raw

SEQ ID NO: 552404 - DNA, 508 bp, Homo sapiens
  misc_feature: HIJSMM301DG99F.16.46.E02.1.454.light.4.raw
tgtactactccacgaccggtgctcgatttagactcatctacagggaaagggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcact

SEQ ID NO: 552405 - DNA, 492 bp, Homo sapiens; identical to SEQ ID NO: 534967
  misc_feature: HIJSMM301AMZP9.47.64.F09.1.454.light.4.raw

SEQ ID NO: 552406 - DNA, 502 bp, Homo sapiens; identical to SEQ ID NO: 551357
  misc_feature: HIJSMM301DPWSV.9.12.B01.1.454.light.4.raw

SEQ ID NO: 552407 - DNA, 495 bp, Homo sapiens
  misc_feature: HIJSMM301CCMM1.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggacccaagctggacgatcaaacgaactgtgg

SEQ ID NO: 552408 - DNA, 491 bp, Homo sapiens
  misc_feature: HIJSMM301C5W3G.41.39.D06.1.454.light.4.raw
tctatactatcacgaccggtgctcgatttagtgacatctcgcagttctttggggagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacaggttcagtggcagtgggtctgggacagacttcactctctccatcagcagactggagcctgaagattttgcaatttattactgtcaccagtatggtagttcacctctaactttcggcggagggaccaaggtggaggatcaaacgaactgtggctgcaccatct

SEQ ID NO: 552409 - DNA, 493 bp, Homo sapiens; identical to SEQ ID NO: 535084
  misc_feature: HIJSMM301DT5PD.47.64.F09.1.454.light.4.raw

SEQ ID NO: 552410 - DNA, 494 bp, Homo sapiens; identical to SEQ ID NO: 534992
  misc_feature: HIJSMM301ALNIA.9.1.A01.1.454.light.4.raw

SEQ ID NO: 552411 - DNA, 454 bp, Homo sapiens; identical to SEQ ID NO: 534964
  misc_feature: HIJSMM301D4VVM.19.86.H09.1.454.light.4.raw

SEQ ID NO: 552412 - DNA, 479 bp, Homo sapiens; identical to SEQ ID NO: 535118
  misc_feature: HIJSMM301AIRDG.13.59.F04.1.454.light.4.raw

SEQ ID NO: 552413 - DNA, 483 bp, Homo sapiens
  misc_feature: HIJSMM301ECRL2.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggcgctcaccttcggccaagggacacgactggagattaaacgaactgtggctgcaccat

SEQ ID NO: 552414 - DNA, 498 bp, Homo sapiens
  misc_feature: HIJSMM301AFCHM.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggtcggagggaccgagggtggagagtcaaacgaaactgtggcgtgcaccactctgtcttcat

SEQ ID NO: 552415 - DNA, 504 bp, Homo sapiens; identical to SEQ ID NO: 551788
  misc_feature: HIJSMM301AQZVK.12.53.E09.1.454.light.4.raw

SEQ ID NO: 552416 - DNA, 402 bp, Homo sapiens
  misc_feature: HIJSMM301AFQG8.8.87.H10.1.454.light.4.raw
ctcgcgtgtccacgaccggtgctcgatttagcagtactgcgttgggtttgggcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacacgcgag

SEQ ID NO: 552417 - DNA, 511 bp, Homo sapiens
  misc_feature: HIJSMM301B1ZXE.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaacccactgtcactctgttcccacctcctcga

SEQ ID NO: 552418 - DNA, 472 bp, Homo sapiens
  misc_feature: HIJSMM301CQAZK.9.15.B04.1.454.light.4.raw
tgatacgtctcacgaccggtgctcgatttagacagtatatatccgcggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagcctccctgaccatcagtgaattgcagactgaggatgaggctaactactactgccagtcctccgacagcagcctgggtgtttgggtgttcggcggac

SEQ ID NO: 552419 - DNA, 441 bp, Homo sapiens; identical to SEQ ID NO: 534971
  misc_feature: HIJSMM301ATQC6.11.3.A03.1.454.light.4.raw

SEQ ID NO: 552420 - DNA, 501 bp, Homo sapiens; identical to SEQ ID NO: 536867
  misc_feature: HIJSMM301DAHZD.5.86.H09.1.454.light.4.raw

SEQ ID NO: 552421 - DNA, 503 bp, Homo sapiens; identical to SEQ ID NO: 547049
  misc_feature: HIJSMM301C93SI.18.59.F04.1.454.light.4.raw

SEQ ID NO: 552422 - DNA, 496 bp, Homo sapiens
  misc_feature: HIJSMM301CFAQ9.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtcctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcacc

SEQ ID NO: 552423 - DNA, 517 bp, Homo sapiens
  misc_feature: HIJSMM301BYKEO.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgccctcctcacg

SEQ ID NO: 552424 - DNA, 478 bp, Homo sapiens
  misc_feature: HIJSMM301C7XYE.51.28.C06.1.454.light.4.raw
cgatcgtatacacgaccggtgctcgatttagagctcacgtattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctctacgtttcgggcgggggaccgaaggtggagatcaagcgaactgtggctgca

SEQ ID NO: 552425 - DNA, 494 bp, Homo sapiens; identical to SEQ ID NO: 534992
  misc_feature: HIJSMM301CNOYL.9.1.A01.1.454.light.4.raw

SEQ ID NO: 552426 - DNA, 494 bp, Homo sapiens; identical to SEQ ID NO: 535828
  misc_feature: HIJSMM301DMVU2.3.36.D03.1.454.light.4.raw

SEQ ID NO: 552427 - DNA, 489 bp, Homo sapiens
  misc_feature: HIJSMM301EZBYZ.11.76.G10.1.454.light.4.raw
cgagagataccacgaccggtgctcgatttagtcactcatacaggggacaacaggcaggcaggggcagcaagatggtgttgcagaccccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggccagcttattattgtcagcaatattattacttcttcttccgtatctacttttggccgacggggaccgaggcgtggagatcagacgaact

SEQ ID NO: 552428 - DNA, 498 bp, Homo sapiens
  misc_feature: HIJSMM301EPB8B.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacttcggcggagggaccaaggtggagatcaaacgaactgtggctgcaccatctgtcttcatcttccccg

SEQ ID NO: 552429 - DNA, 494 bp, Homo sapiens; identical to SEQ ID NO: 534994
  misc_feature: HIJSMM301CMAKX.27.78.H01.1.454.light.4.raw

SEQ ID NO: 552430 - DNA, 518 bp, Homo sapiens
  misc_feature: HIJSMM301AWFS8.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttcctcccccggacgttcggtccaacggaccgaacggtagggaaagtacaacgacgaacgtagtggcgtggcaccactctgtcttctatcttcccgt

SEQ ID NO: 552431 - DNA, 497 bp, Homo sapiens; identical to SEQ ID NO: 538061
  misc_feature: HIJSMM301BKB6F.16.46.E02.1.454.light.4.raw

SEQ ID NO: 552432 - DNA, 493 bp, Homo sapiens
  misc_feature: HIJSMM301A6U9P.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtaagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgtctt

SEQ ID NO: 552433 - DNA, 505 bp, Homo sapiens
  misc_feature: HIJSMM301BAXYF.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccaccctcctcg

SEQ ID NO: 552434 - DNA, 504 bp, Homo sapiens
  misc_feature: HIJSMM301CD34Y.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcactc

SEQ ID NO: 552435 - DNA, 490 bp, Homo sapiens
  misc_feature: HIJSMM301CR9IT.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttatactgtcaacaatattatattattccgaggacttcggcagggaccaaggtggaaatcaaacgaatagtggctgcaccat

SEQ ID NO: 552436 - DNA, 511 bp, Homo sapiens
  misc_feature: HIJSMM301BMR3I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaaggtaggaaatacaaaacgaactagtggcgtgcaccactctgtcttctatcttccccg

SEQ ID NO: 552437 - DNA, 485 bp, Homo sapiens; identical to SEQ ID NO: 535606
  misc_feature: HIJSMM301EGECR.47.46.E02.1.454.light.4.raw

SEQ ID NO: 552438 - DNA, 447 bp, Homo sapiens; identical to SEQ ID NO: 535020
  misc_feature: HIJSMM301AHQLE.18.9.A09.1.454.light.4.raw

SEQ ID NO: 552439 - DNA, 489 bp, Homo sapiens; identical to SEQ ID NO: 535139
  misc_feature: HIJSMM301B4O8N.14.55.E11.1.454.light.4.raw

SEQ ID NO: 552440 - DNA, 508 bp, Homo sapiens
  misc_feature: HIJSMM301ARFUU.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 552441 - DNA, 354 bp, Homo sapiens; identical to SEQ ID NO: 535026
  misc_feature: HIJSMM301BDZ8P.19.22.B11.1.454.light.4.raw

SEQ ID NO: 552442 - DNA, 513 bp, Homo sapiens
  misc_feature: HIJSMM301BPNHA.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccc

SEQ ID NO: 552443 - DNA, 441 bp, Homo sapiens; identical to SEQ ID NO: 534971
  misc_feature: HIJSMM301ELV8V.11.3.A03.1.454.light.4.raw

SEQ ID NO: 552444 - DNA, 447 bp, Homo sapiens; identical to SEQ ID NO: 535201
  misc_feature: HIJSMM301D4E3M.18.9.A09.1.454.light.4.raw

SEQ ID NO: 552445 - DNA, 512 bp, Homo sapiens
  misc_feature: HIJSMM301D4XQE.22.36.D03.1.454.light.4.raw
acatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcattatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctcg

SEQ ID NO: 552446 - DNA, 481 bp, Homo sapiens; identical to SEQ ID NO: 535993
  misc_feature: HIJSMM301AVJ3X.21.25.C03.1.454.light.4.raw

SEQ ID NO: 552447 - DNA, 483 bp, Homo sapiens; identical to SEQ ID NO: 537175
  misc_feature: HIJSMM301BF364.40.15.B04.1.454.light.4.raw

SEQ ID NO: 552448 - DNA, 488 bp, Homo sapiens
  misc_feature: HIJSMM301BIN9N.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacatggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcga

SEQ ID NO: 552449 - DNA, 485 bp, Homo sapiens; identical to SEQ ID NO: 538954
  misc_feature: HIJSMM301DV0O9.3.55.E11.1.454.light.4.raw

SEQ ID NO: 552450 - DNA, 508 bp, Homo sapiens
  misc_feature: HIJSMM301BH8CK.22.46.E02.1.454.light.4.raw
acatacgcgtcacgaccggtgctcgatttagactcatctacagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcgggcggagggccaaagtgaccgtcctaggtcagcccaaggctgccccctcggtcactc

SEQ ID NO: 552451 - DNA, 447 bp, Homo sapiens; identical to SEQ ID NO: 535020
  misc_feature: HIJSMM301CGYUR.18.9.A09.1.454.light.4.raw

SEQ ID NO: 552452 - DNA, 514 bp, Homo sapiens; identical to SEQ ID NO: 546238
  misc_feature: HIJSMM301D0HW9.47.85.H08.1.454.light.4.raw

SEQ ID NO: 552453 - DNA, 513 bp, Homo sapiens
  misc_feature: HIJSMM301CGJD1.7.34.D01.1.454.light.4.raw
cgtgtctctacacgaccggtgctcgatttagatcgtctgtgttggggtttgggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactc

SEQ ID NO: 552454 - DNA, 493 bp, Homo sapiens; identical to SEQ ID NO: 535657
  misc_feature: HIJSMM301D8Y7Z.27.78.H01.1.454.light.4.raw

SEQ ID NO: 552455 - DNA, 486 bp, Homo sapiens
  misc_feature: HIJSMM301AUGXR.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagactgaccgtcctgcgtcagcccaaggctgccccctcggtcactctgttcccaccctcctcgctacgtaga

SEQ ID NO: 552456 - DNA, 498 bp, Homo sapiens
  misc_feature: HIJSMM301BVZ6X.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacggatttcactctcaccatcagcagcctgcaggctgaagatgtggcagtttattattgtcaacaatattattatacttcgtggacgttcggtccaagggaccaaggtggatatcagacgaactgtggctgca

SEQ ID NO: 552457 - DNA, 497 bp, Homo sapiens
  misc_feature: HIJSMM301AVVW6.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccctcggtcactctgttcccaccctcctcgagtgcgtct

SEQ ID NO: 552458 - DNA, 484 bp, Homo sapiens; identical to SEQ ID NO: 535240
  misc_feature: HIJSMM301C48X1.47.60.F05.1.454.light.4.raw

SEQ ID NO: 552459 - DNA, 470 bp, Homo sapiens
  misc_feature: HIJSMM301E3IUC.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattaactgtcaaaagaatagcgctgcccccgctccagtttcggcggagggaccaaggtggagataac

SEQ ID NO: 552460 - DNA, 490 bp, Homo sapiens
  misc_feature: HIJSMM301CIBI9.51.30.C08.1.454.light.4.raw
cgatcgtatacacgaccggtgctcgatttagtctgacgtcaaagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 552461 - DNA, 488 bp, Homo sapiens
  misc_feature: HIJSMM301B29Y2.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcgccagggaccgaaggtaggaaagtcaaacgaactgtggcgtgcaca

SEQ ID NO: 552462 - DNA, 502 bp, Homo sapiens
  misc_feature: HIJSMM301AMVZO.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagattaaacg

SEQ ID NO: 552463 - DNA, 486 bp, Homo sapiens; identical to SEQ ID NO: 535385
  misc_feature: HIJSMM301DE3V3.19.71.G05.1.454.light.4.raw

SEQ ID NO: 552464 - DNA, 508 bp, Homo sapiens; identical to SEQ ID NO: 536062
  misc_feature: HIJSMM301C2BQ9.11.57.F02.1.454.light.4.raw

SEQ ID NO: 552465 - DNA, 501 bp, Homo sapiens; identical to SEQ ID NO: 538431
  misc_feature: HIJSMM301AE8T1.21.22.B11.1.454.light.4.raw

SEQ ID NO: 552466 - DNA, 513 bp, Homo sapiens; identical to SEQ ID NO: 543053
  misc_feature: HIJSMM301DSCVC.17.33.C11.1.454.light.4.raw
  modified_base (506)..(506): a, c, t, g, unknown or other

SEQ ID NO: 552467 - DNA, 518 bp, Homo sapiens
  misc_feature: HIJSMM301DQGPU.9.2.A02.1.454.light.4.raw
tgatacgtctcacgaccggtgctcgatttagactcatctacaggggggggtcgtcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccgccct

SEQ ID NO: 552468 - DNA, 486 bp, Homo sapiens; identical to SEQ ID NO: 537127
  misc_feature: HIJSMM301DBDM1.3.77.G11.1.454.light.4.raw

SEQ ID NO: 552469 - DNA, 499 bp, Homo sapiens
  misc_feature: HIJSMM301A01NA.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccgaaactgaccgtcctaggtcagcccaaggctgccccctcc

SEQ ID NO: 552470 - DNA, 480 bp, Homo sapiens
  misc_feature: HIJSMM301BMM6D.21.22.B11.1.454.light.4.raw
  modified_base (467)..(467): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggtggtgtcgacggnggacaatgacgtc

SEQ ID NO: 552471 - DNA, 446 bp, Homo sapiens
  misc_feature: HIJSMM301ASX7T.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctcatactcgta

SEQ ID NO: 552472 - DNA, 489 bp, Homo sapiens
  misc_feature: HIJSMM301CERAZ.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaagagccaccatctcctggtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagtttattactgtcagcagtatcataactggccgctcaccttcggccaagggacacgactggagattaaacgaactgtggctgcaccat

SEQ ID NO: 552473 - DNA, 498 bp, Homo sapiens
  misc_feature: HIJSMM301AUU7A.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccactgtcactctcgttcccgcctcctcgtatctctcg

SEQ ID NO: 552474 - DNA, 495 bp, Homo sapiens; identical to SEQ ID NO: 536359
  misc_feature: HIJSMM301DZNIJ.48.4.A04.1.454.light.4.raw

SEQ ID NO: 552475 - DNA, 514 bp, Homo sapiens
  misc_feature: HIJSMM301ECBMU.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctca

SEQ ID NO: 552476 - DNA, 500 bp, Homo sapiens; identical to SEQ ID NO: 540484
  misc_feature: HIJSMM301CFD74.48.73.G07.1.454.light.4.raw

SEQ ID NO: 552477 - DNA, 502 bp, Homo sapiens
  misc_feature: HIJSMM301A2OIW.49.68.G02.1.454.light.4.raw
agtcgagagacacgaccggtgctcgatttagtcgatagtgaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 552478 - DNA, 483 bp, Homo sapiens
  misc_feature: HIJSMM301C9Q7B.49.81.H04.1.454.light.4.raw
agtcgagagacacgaccggtgctcgatttagtagtgtagattcgcgggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggaggatcaaacgaactgtggctgcaccat

SEQ ID NO: 552479 - DNA, 495 bp, Homo sapiens
  misc_feature: HIJSMM301BRAXI.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtctgggtcagcccaaggcccaaccccactgtcact

SEQ ID NO: 552480 - DNA, 493 bp, Homo sapiens
  misc_feature: HIJSMM301CVTZ8.27.78.H01.1.454.light.4.raw
  modified_base (379)..(379): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggcacgactggagattaaacgaactgtggctgcaccatctgtctt

SEQ ID NO: 552481 - DNA, 513 bp, Homo sapiens
  misc_feature: HIJSMM301C8VWH.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcct

SEQ ID NO: 552482 - DNA, 486 bp, Homo sapiens; identical to SEQ ID NO: 551132
  misc_feature: HIJSMM301ATAZD.4.71.G05.1.454.light.4.raw

SEQ ID NO: 552483 - DNA, 441 bp, Homo sapiens; identical to SEQ ID NO: 534971
  misc_feature: HIJSMM301B7RGA.11.3.A03.1.454.light.4.raw

SEQ ID NO: 552484 - DNA, 494 bp, Homo sapiens; identical to SEQ ID NO: 534994
  misc_feature: HIJSMM301BCEC0.27.78.H01.1.454.light.4.raw

SEQ ID NO: 552485 - DNA, 482 bp, Homo sapiens
  misc_feature: HIJSMM301ASKT5.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagactgaccgtccctaagtcagcccaac

SEQ ID NO: 552486 - DNA, 511 bp, Homo sapiens; identical to SEQ ID NO: 547172
  misc_feature: HIJSMM301ASZPH.11.57.F02.1.454.light.4.raw

SEQ ID NO: 552487 - DNA, 483 bp, Homo sapiens; identical to SEQ ID NO: 542254
  misc_feature: HIJSMM301CJPO6.22.6.A06.1.454.light.4.raw

SEQ ID NO: 552488 - DNA, 479 bp, Homo sapiens
  misc_feature: HIJSMM301BAHFO.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctggacgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccggcggtggagatcagacgaactgtggctgcaccatctgtctt

SEQ ID NO: 552489 - DNA, 490 bp, Homo sapiens; identical to SEQ ID NO: 535119
  misc_feature: HIJSMM301AY3IY.51.71.G05.1.454.light.4.raw

SEQ ID NO: 552490 - DNA, 508 bp, Homo sapiens
  misc_feature: HIJSMM301B1270.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggagggccaaggtggagatcaagcgaactgtggctgcaccatctgtcttcatcttcccg

SEQ ID NO: 552491 - DNA, 498 bp, Homo sapiens
  misc_feature: HIJSMM301EQFY6.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggtagggaccaagctgaccgtcctaggtcagcccaaggctgccccctcggt

SEQ ID NO: 552492 - DNA, 489 bp, Homo sapiens; identical to SEQ ID NO: 536013
  misc_feature: HIJSMM301APR2T.26.23.C01.1.454.light.4.raw

SEQ ID NO: 552493 - DNA, 476 bp, Homo sapiens
  misc_feature: HIJSMM301D0ZZK.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtgggtcccatcaaggttcagcggcagtggatctgggacagatttcactctcaccatcagcagcctacagcctgaagattttgcaacttattactgtcaacagcttaataattacgcgctcactttcggcggagggaccaaaggtggagatcaaacgaactgtggctgcaccat

SEQ ID NO: 552494 - DNA, 512 bp, Homo sapiens
  misc_feature: HIJSMM301B59WC.51.27.C05.1.454.light.4.raw
cgatcgtatacacgaccggtgctcgatttagacgcgatcgaagggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtcggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgtt

SEQ ID NO: 552495 - DNA, 491 bp, Homo sapiens; identical to SEQ ID NO: 545038
  misc_feature: HIJSMM301AGZME.22.25.C03.1.454.light.4.raw

SEQ ID NO: 552496 - DNA, 494 bp, Homo sapiens; identical to SEQ ID NO: 539894
  misc_feature: HIJSMM301DKC7O.16.53.E09.1.454.light.4.raw

SEQ ID NO: 552497 - DNA, 454 bp, Homo sapiens; identical to SEQ ID NO: 534964
  misc_feature: HIJSMM301EPGN1.19.86.H09.1.454.light.4.raw

SEQ ID NO: 552498 - DNA, 495 bp, Homo sapiens
  misc_feature: HIJSMM301CX7N9.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcaagggaccaaggtggatatcagacgaactgtcggctg

SEQ ID NO: 552499 - DNA, 491 bp, Homo sapiens
  misc_feature: HIJSMM301C5O2Y.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgaaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactgtggctgcaccatctgtcttcatcttcccgccat

SEQ ID NO: 552500 - DNA, 494 bp, Homo sapiens; identical to SEQ ID NO: 534992
  misc_feature: HIJSMM301AG0LU.9.1.A01.1.454.light.4.raw

SEQ ID NO: 552501 - DNA, 474 bp, Homo sapiens; identical to SEQ ID NO: 543944
  misc_feature: HIJSMM301DM3J6.5.70.G04.1.454.light.4.raw

SEQ ID NO: 552502 - DNA, 494 bp, Homo sapiens
  misc_feature: HIJSMM301AMXTR.13.11.A11.1.454.light.4.raw
tcacgtactacacgaccggtgctcgatttagctacgactgcaggggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatt

SEQ ID NO: 552503 - DNA, 460 bp, Homo sapiens; identical to SEQ ID NO: 537107
  misc_feature: HIJSMM301CS81E.22.28.C06.1.454.light.4.raw

SEQ ID NO: 552504 - DNA, 503 bp, Homo sapiens
  misc_feature: HIJSMM301DTLOA.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 552505 - DNA, 492 bp, Homo sapiens
  misc_feature: HIJSMM301ADU69.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacgacgactggagattaaacgaaactagtggcgtgcaccactctgtt

SEQ ID NO: 552506 - DNA, 484 bp, Homo sapiens
  misc_feature: HIJSMM301BO7E4.41.33.C11.1.454.light.4.raw
tctatactatcacgaccggtgctcgatttagagtgagctcgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaccta

SEQ ID NO: 552507 - DNA, 501 bp, Homo sapiens; identical to SEQ ID NO: 542622
  misc_feature: HIJSMM301BSSAO.14.57.F02.1.454.light.4.raw

SEQ ID NO: 552508 - DNA, 499 bp, Homo sapiens
  misc_feature: HIJSMM301CSQMX.18.59.F04.1.454.light.4.raw
tacgagtatgcacgaccggtgctcgatttagtacacacacttagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccca

SEQ ID NO: 552509 - DNA, 447 bp, Homo sapiens; identical to SEQ ID NO: 535201
  misc_feature: HIJSMM301DJF6W.18.9.A09.1.454.light.4.raw

SEQ ID NO: 552510 - DNA, 512 bp, Homo sapiens
  misc_feature: HIJSMM301CMO81.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgccaaggaccgaacggtggaaagtacaagacgaacctagtggcgtgcaccaactctgtcttctactcttcccgt

SEQ ID NO: 552511 - DNA, 511 bp, Homo sapiens; identical to SEQ ID NO: 535945
  misc_feature: HIJSMM301DM5HP.43.23.C01.1.454.light.4.raw

SEQ ID NO: 552512 - DNA, 444 bp, Homo sapiens
  misc_feature: HIJSMM301DQCPP.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttcccgccctcctccgtgtctgat

SEQ ID NO: 552513 - DNA, 491 bp, Homo sapiens
  misc_feature: HIJSMM301C81LR.48.34.D01.1.454.light.4.raw
agtatacatacacgaccggtgctcgatttagatcgtctgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 552514 - DNA, 501 bp, Homo sapiens
  misc_feature: HIJSMM301CN9GL.48.27.C05.1.454.light.4.raw
agtatacatacacgaccggtgctcgatttagacgcgatcgaagggtttgggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccgcc

SEQ ID NO: 552515 - DNA, 488 bp, Homo sapiens
  misc_feature: HIJSMM301AJDO3.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaacccca

SEQ ID NO: 552516 - DNA, 502 bp, Homo sapiens
  misc_feature: HIJSMM301EX98L.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctggaccaaagtggatatcaaacgaactgtggctgcaccatctgtctt

SEQ ID NO: 552517 - DNA, 454 bp, Homo sapiens; identical to SEQ ID NO: 534964
  misc_feature: HIJSMM301AQ5K5.19.86.H09.1.454.light.4.raw

SEQ ID NO: 552518 - DNA, 496 bp, Homo sapiens
  misc_feature: HIJSMM301BBOTO.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagaattaaaggaactgtggctgcaccatctgtcttcatcttccccg

SEQ ID NO: 552519 - DNA, 492 bp, Homo sapiens
  misc_feature: HIJSMM301B6VLN.10.72.G06.1.454.light.4.raw
catagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 552520 - DNA, 486 bp, Homo sapiens
  misc_feature: HIJSMM301DOOC7.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaacgaactgt

SEQ ID NO: 552521 - DNA, 479 bp, Homo sapiens; identical to SEQ ID NO: 537163
  misc_feature: HIJSMM301D7ZI3.13.73.G07.1.454.light.4.raw

SEQ ID NO: 552522 - DNA, 484 bp, Homo sapiens; identical to SEQ ID NO: 535211
  misc_feature: HIJSMM301AVBLP.47.46.E02.1.454.light.4.raw

SEQ ID NO: 552523 - DNA, 504 bp, Homo sapiens
  misc_feature: HIJSMM301CWBMJ.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctgggtccctgatcgcttctctggttccatccttgggaacaaagctgccctcaccatcgcggggcccaggcagatgatgagtgtgattattactgtgtgctctatatgggcagtggcgtttgggtgttcggcggagggaccaagctgaccgttcg

SEQ ID NO: 552524 - DNA, 489 bp, Homo sapiens; identical to SEQ ID NO: 535139
  misc_feature: HIJSMM301EWGPC.14.55.E11.1.454.light.4.raw

SEQ ID NO: 552525 - DNA, 497 bp, Homo sapiens; identical to SEQ ID NO: 543330
  misc_feature: HIJSMM301CWRCN.9.39.D06.1.454.light.4.raw

SEQ ID NO: 552526 - DNA, 441 bp, Homo sapiens; identical to SEQ ID NO: 534971
  misc_feature: HIJSMM301DMR86.11.3.A03.1.454.light.4.raw

SEQ ID NO: 552527 - DNA, 508 bp, Homo sapiens
  misc_feature: HIJSMM301B4HNW.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtctaccg

SEQ ID NO: 552528 - DNA, 455 bp, Homo sapiens
  misc_feature: HIJSMM301CFAWZ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgcccctcggtcactctcgttcccaccctcctccacgagagta

SEQ ID NO: 552529 - DNA, 496 bp, Homo sapiens
  misc_feature: HIJSMM301BJTR8.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattaagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 552530 - DNA, 498 bp, Homo sapiens
  misc_feature: HIJSMM301EAB5Z.43.15.B04.1.454.light.4.raw
tgtgagtagtcacgaccggtgctcgattagacagtatatatccggcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaaggggacttcggccaggaccaggtgattcaccgaactgtggctgcaccatctgtcttcatcttcccg

SEQ ID NO: 552531 - DNA, 520 bp, Homo sapiens
  misc_feature: HIJSMM301DSM3O.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccagggtttctgatcgcttctatggctccaagtctgcctacacggcctccctgaccatctccgggctccagcctgaggacgaggctgattattattgtagttcatatacaaccagtgacacttgggtgttcggtggagggaccaggctgaccgtcctaggtcagcccaaggctgccccctcggtcactctgttcccaccct

SEQ ID NO: 552532 - DNA, 484 bp, Homo sapiens
  misc_feature: HIJSMM301CEDSG.47.62.F07.1.454.light.4.raw
  modified_base (363)..(363): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttnaccatcagcagcctgcagcctgaagatattgcaacatattactgtcaacagtatcataatctccccactttcggccctgggaccaagtggatatcaaacgaactgtggctgcaccatctgt

SEQ ID NO: 552533 - DNA, 486 bp, Homo sapiens; identical to SEQ ID NO: 535523
  misc_feature: HIJSMM301BXB5S.22.73.G07.1.454.light.4.raw

SEQ ID NO: 552534 - DNA, 472 bp, Homo sapiens; identical to SEQ ID NO: 535898
  misc_feature: HIJSMM301CQ8OW.15.8.A08.1.454.light.4.raw

SEQ ID NO: 552535 - DNA, 473 bp, Homo sapiens; identical to SEQ ID NO: 546369
  misc_feature: HIJSMM301DGKAD.18.76.G10.1.454.light.4.raw

SEQ ID NO: 552536 - DNA, 512 bp, Homo sapiens
  misc_feature: HIJSMM301BXOC0.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 552537 - DNA, 517 bp, Homo sapiens
  misc_feature: HIJSMM301C4M1G.47.53.E09.1.454.light.4.raw
agctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccct

SEQ ID NO: 552538 - DNA, 506 bp, Homo sapiens
  misc_feature: HIJSMM301DUHCU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaacggtggaaatcaaacgaactgtggctgcaccactctgtcttcatcttccccg

SEQ ID NO: 552539 - DNA, 489 bp, Homo sapiens; identical to SEQ ID NO: 540424
  misc_feature: HIJSMM301CFSRK.17.25.C03.1.454.light.4.raw

SEQ ID NO: 552540 - DNA, 496 bp, Homo sapiens; identical to SEQ ID NO: 536690
  misc_feature: HIJSMM301CAFFU.40.23.C01.1.454.light.4.raw

SEQ ID NO: 552541 - DNA, 445 bp, Homo sapiens; identical to SEQ ID NO: 546083
  misc_feature: HIJSMM301DQYKF.5.9.A09.1.454.light.4.raw

SEQ ID NO: 552542 - DNA, 502 bp, Homo sapiens; identical to SEQ ID NO: 536253
  misc_feature: HIJSMM301BJSMF.21.22.B11.1.454.light.4.raw

SEQ ID NO: 552543 - DNA, 515 bp, Homo sapiens; identical to SEQ ID NO: 541898
  misc_feature: HIJSMM301AEJ1K.16.66.F11.1.454.light.4.raw

SEQ ID NO: 552544 - DNA, 479 bp, Homo sapiens
  misc_feature: HIJSMM301A5BOX.3.33.C11.1.454.light.4.raw
agacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaacagtataatacccgcgtgacgttcggccaagggaccaaggtggagatcatacgaactgtggctgcacc

SEQ ID NO: 552545 - DNA, 517 bp, Homo sapiens
  misc_feature: HIJSMM301DVMT0.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggcctgccccctcggtcactctgttcccgccctcctcg

SEQ ID NO: 552546 - DNA, 494 bp, Homo sapiens; identical to SEQ ID NO: 534994
  misc_feature: HIJSMM301B9NMF.27.78.H01.1.454.light.4.raw

SEQ ID NO: 552547 - DNA, 503 bp, Homo sapiens
  misc_feature: HIJSMM301DI83F.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaacccca

SEQ ID NO: 552548 - DNA, 503 bp, Homo sapiens; identical to SEQ ID NO: 538884
  misc_feature: HIJSMM301BRNLN.27.78.H01.1.454.light.4.raw

SEQ ID NO: 552549 - DNA, 493 bp, Homo sapiens; identical to SEQ ID NO: 539456
  misc_feature: HIJSMM301BIVZO.10.79.H02.1.454.light.4.raw

SEQ ID NO: 552550 - DNA, 514 bp, Homo sapiens; identical to SEQ ID NO: 538885
  misc_feature: HIJSMM301D3NOO.14.19.B08.1.454.light.4.raw

SEQ ID NO: 552551 - DNA, 496 bp, Homo sapiens; identical to SEQ ID NO: 535109
  misc_feature: HIJSMM301BSNMA.16.78.H01.1.454.light.4.raw

SEQ ID NO: 552552 - DNA, 486 bp, Homo sapiens; identical to SEQ ID NO: 535043
  misc_feature: HIJSMM301B790D.46.35.D02.1.454.light.4.raw

SEQ ID NO: 552553 - DNA, 473 bp, Homo sapiens; identical to SEQ ID NO: 538793
  misc_feature: HIJSMM301D4Y5U.5.34.D01.1.454.light.4.raw

SEQ ID NO: 552554 - DNA, 488 bp, Homo sapiens; identical to SEQ ID NO: 535990
  misc_feature: HIJSMM301AGKBM.11.28.C06.1.454.light.4.raw

SEQ ID NO: 552555 - DNA, 502 bp, Homo sapiens
  misc_feature: HIJSMM301C88SM.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtgaaagtcaaacgaactagtggctgcaccatctgtcttctatcttccc

SEQ ID NO: 552556 - DNA, 496 bp, Homo sapiens; identical to SEQ ID NO: 535109
  misc_feature: HIJSMM301C4SW4.16.78.H01.1.454.light.4.raw

SEQ ID NO: 552557 - DNA, 485 bp, Homo sapiens; identical to SEQ ID NO: 543441
  misc_feature: HIJSMM301B0ECC.26.55.E11.1.454.light.4.raw

SEQ ID NO: 552558 - DNA, 501 bp, Homo sapiens
  misc_feature: HIJSMM301BYIJP.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtagggtggagggctgaggatgttggggtttattacttgcatgcaagttctacaaacttcctacacttttggtccaggggaccaaagctggagatcaaacgaaactgtggctgca

SEQ ID NO: 552559 - DNA, 484 bp, Homo sapiens; identical to SEQ ID NO: 537427
  misc_feature: HIJSMM301A5602.26.78.H01.1.454.light.4.raw

SEQ ID NO: 552560 - DNA, 486 bp, Homo sapiens; identical to SEQ ID NO: 539294
  misc_feature: HIJSMM301D906X.12.33.C11.1.454.light.4.raw

SEQ ID NO: 552561 - DNA, 500 bp, Homo sapiens
  misc_feature: HIJSMM301CRA8D.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgccctcctcccacgagagta

SEQ ID NO: 552562 - DNA, 492 bp, Homo sapiens; identical to SEQ ID NO: 539732
  misc_feature: HIJSMM301AN5DF.4.9.A09.1.454.light.4.raw

SEQ ID NO: 552563 - DNA, 498 bp, Homo sapiens
  misc_feature: HIJSMM301CO8I9.3.35.D02.1.454.light.4.raw
agacgcactccacgaccggtgctcgatttagcacacgatagttgggtttggggtgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttattctgcatgcaagctacacactggccgtacacttttggccaggggaccaagctggagatcaaacgaactgtggctgcaccta

SEQ ID NO: 552564 - DNA, 478 bp, Homo sapiens
  misc_feature: HIJSMM301BHTT3.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactatgtcagcaatatgatttgctcctccgagtgccacttttgggtcggggggaccggaacgtaggtacgatcaaacgaaa

SEQ ID NO: 552565 - DNA, 489 bp, Homo sapiens; identical to SEQ ID NO: 535139
  misc_feature: HIJSMM301CZ8QY.14.55.E11.1.454.light.4.raw

SEQ ID NO: 552566 - DNA, 355 bp, Homo sapiens
  misc_feature: HIJSMM301CN3U2.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctggggacagatttcactctcacca

SEQ ID NO: 552567 - DNA, 501 bp, Homo sapiens; identical to SEQ ID NO: 536818
  misc_feature: HIJSMM301A6ERI.12.82.H05.1.454.light.4.raw

SEQ ID NO: 552568 - DNA, 522 bp, Homo sapiens
  misc_feature: HIJSMM301CL17X.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccgtcgtcactctcgtcccgcccct

SEQ ID NO: 552569 - DNA, 498 bp, Homo sapiens; identical to SEQ ID NO: 544885
  misc_feature: HIJSMM301DRFOJ.3.71.G05.1.454.light.4.raw

SEQ ID NO: 552570 - DNA, 496 bp, Homo sapiens; identical to SEQ ID NO: 540594
  misc_feature: HIJSMM301BF3DK.4.59.F04.1.454.light.4.raw

SEQ ID NO: 552571 - DNA, 495 bp, Homo sapiens; identical to SEQ ID NO: 535007
  misc_feature: HIJSMM301CS1DU.22.5.A05.1.454.light.4.raw

SEQ ID NO: 552572 - DNA, 505 bp, Homo sapiens
  misc_feature: HIJSMM301CIOYX.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctcgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 552573 - DNA, 503 bp, Homo sapiens; identical to SEQ ID NO: 536834
  misc_feature: HIJSMM301EPRA1.2.35.D02.1.454.light.4.raw

SEQ ID NO: 552574 - DNA, 479 bp, Homo sapiens
  misc_feature: HIJSMM301B3U7K.19.71.G05.1.454.light.4.raw
  modified_base (447)..(447): a, c, t, g, unknown or other
  modified_base (466)..(466): a, c, t, g, unknown or other
  modified_base (470)..(470): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttntggacgtgcaggaccaagngganatcagagaa

SEQ ID NO: 552575 - DNA, 493 bp, Homo sapiens; identical to SEQ ID NO: 544448
  misc_feature: HIJSMM301BC5HY.15.59.F04.1.454.light.4.raw

SEQ ID NO: 552576 - DNA, 505 bp, Homo sapiens; identical to SEQ ID NO: 535987
  misc_feature: HIJSMM301AU905.18.37.D04.1.454.light.4.raw

SEQ ID NO: 552577 - DNA, 489 bp, Homo sapiens; identical to SEQ ID NO: 546768
  misc_feature: HIJSMM301CGVH0.4.33.C11.1.454.light.4.raw

SEQ ID NO: 552578 - DNA, 495 bp, Homo sapiens; identical to SEQ ID NO: 539267
  misc_feature: HIJSMM301CRDAS.21.27.C05.1.454.light.4.raw

SEQ ID NO: 552579 - DNA, 490 bp, Homo sapiens; identical to SEQ ID NO: 535526
  misc_feature: HIJSMM301BREOX.26.78.H01.1.454.light.4.raw

SEQ ID NO: 552580 - DNA, 493 bp, Homo sapiens; identical to SEQ ID NO: 535084
  misc_feature: HIJSMM301D5DJB.47.64.F09.1.454.light.4.raw

SEQ ID NO: 552581 - DNA, 491 bp, Homo sapiens; identical to SEQ ID NO: 535176
  misc_feature: HIJSMM301BBFNQ.13.39.D06.1.454.light.4.raw

SEQ ID NO: 552582 - DNA, 509 bp, Homo sapiens
  misc_feature: HIJSMM301EQAYZ.40.33.C11.1.454.light.4.raw
tctagcgactcacgaccggtgctcgatttagagtgagctcgttgggtttggggaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 552583 - DNA, 485 bp, Homo sapiens
  misc_feature: HIJSMM301DOSMY.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacgg

SEQ ID NO: 552584 - DNA, 507 bp, Homo sapiens; identical to SEQ ID NO: 535641
  misc_feature: HIJSMM301CDHX5.10.88.H11.1.454.light.4.raw

SEQ ID NO: 552585 - DNA, 445 bp, Homo sapiens
  misc_feature: HIJSMM301DKCY7.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcattctgttcccacccctcctccgtgtctgat

SEQ ID NO: 552586 - DNA, 513 bp, Homo sapiens; identical to SEQ ID NO: 546295
  misc_feature: HIJSMM301CSP4E.19.59.F04.1.454.light.4.raw

SEQ ID NO: 552587 - DNA, 492 bp, Homo sapiens
  misc_feature: HIJSMM301C1QLU.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaacgaactgtggctgcaccatctgtcttcatcttcccg

SEQ ID NO: 552588 - DNA, 486 bp, Homo sapiens
  misc_feature: HIJSMM301CEJK9.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtggagatcaaacgtaacg

SEQ ID NO: 552589 - DNA, 491 bp, Homo sapiens
  misc_feature: HIJSMM301BDZ5Z.15.1.A01.1.454.light.4.raw
tctacgtagccacgaccggtgctcgatttagacgtctcatcagggccgtgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcacgggctttcgtaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctcgttcccaccctcctcgctacgtaga

SEQ ID NO: 552590 - DNA, 447 bp, Homo sapiens; identical to SEQ ID NO: 535201
  misc_feature: HIJSMM301ARO82.18.9.A09.1.454.light.4.raw

SEQ ID NO: 552591 - DNA, 482 bp, Homo sapiens
  misc_feature: HIJSMM301B2SGP.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatct

SEQ ID NO: 552592 - DNA, 496 bp, Homo sapiens
  misc_feature: HIJSMM301AJEH3.49.28.C06.1.454.light.4.raw
agtcgagagacacgaccggtgctcgatttagagctcacgtattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgctagtctattactgtcagcagcgttacaactggcctcccatgtacacttttggccaggggaccaagctaggaaatcgagacgaactgtggctgccaccat

SEQ ID NO: 552593 - DNA, 520 bp, Homo sapiens; identical to SEQ ID NO: 535773
  misc_feature: HIJSMM301BCX99.41.19.B08.1.454.light.4.raw

SEQ ID NO: 552594 - DNA, 444 bp, Homo sapiens; identical to SEQ ID NO: 536685
  misc_feature: HIJSMM301D6T0M.10.76.G10.1.454.light.4.raw

SEQ ID NO: 552595 - DNA, 496 bp, Homo sapiens; identical to SEQ ID NO: 535109
  misc_feature: HIJSMM301AVEIZ.16.78.H01.1.454.light.4.raw

SEQ ID NO: 552596 - DNA, 515 bp, Homo sapiens
  misc_feature: HIJSMM301ERENF.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagccccctaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggcccaaccccactgtcactcttccg

SEQ ID NO: 552597 - DNA, 519 bp, Homo sapiens; identical to SEQ ID NO: 547780
  misc_feature: HIJSMM301B93AC.5.27.C05.1.454.light.4.raw

SEQ ID NO: 552598 - DNA, 498 bp, Homo sapiens
  misc_feature: HIJSMM301A4C77.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgctagtttattactgtcagcagtatgagaagtggttcaagactttcggcggagggaccgaaggtggaggatacaaacgaactgtggctgcaccatctgtcttcatt

SEQ ID NO: 552599 - DNA, 502 bp, Homo sapiens; identical to SEQ ID NO: 543597
  misc_feature: HIJSMM301D73DM.15.25.C03.1.454.light.4.raw

SEQ ID NO: 552600 - DNA, 504 bp, Homo sapiens; identical to SEQ ID NO: 536385
  misc_feature: HIJSMM301B5HZS.27.78.H01.1.454.light.4.raw

SEQ ID NO: 552601 - DNA, 504 bp, Homo sapiens; identical to SEQ ID NO: 535561
  misc_feature: HIJSMM301C1SIB.4.57.F02.1.454.light.4.raw

SEQ ID NO: 552602 - DNA, 484 bp, Homo sapiens; identical to SEQ ID NO: 535240
  misc_feature: HIJSMM301EU7F9.47.60.F05.1.454.light.4.raw

SEQ ID NO: 552603 - DNA, 494 bp, Homo sapiens; identical to SEQ ID NO: 535629
  misc_feature: HIJSMM301A5IPP.4.27.C05.1.454.light.4.raw

SEQ ID NO: 552604 - DNA, 447 bp, Homo sapiens; identical to SEQ ID NO: 535020
  misc_feature: HIJSMM301BB8K0.18.9.A09.1.454.light.4.raw

SEQ ID NO: 552605 - DNA, 494 bp, Homo sapiens; identical to SEQ ID NO: 536444
  misc_feature: HIJSMM301BOGMM.26.72.G06.1.454.light.4.raw

SEQ ID NO: 552606 - DNA, 469 bp, Homo sapiens
  misc_feature: HIJSMM301DFS8E.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcacatcagcaatctgcagtctgaagatttgcagtttattctgtcagcagttacactgcctggagtttgcagggacagctggagctcaacgaactgtggctgcacat

SEQ ID NO: 552607 - DNA, 485 bp, Homo sapiens; identical to SEQ ID NO: 535985
  misc_feature: HIJSMM301BNYLK.15.1.A01.1.454.light.4.raw

SEQ ID NO: 552608 - DNA, 501 bp, Homo sapiens
  misc_feature: HIJSMM301AKG7J.48.27.C05.1.454.light.4.raw
agtatacatacacgaccggtgctcgatttagacgcgatcgaagggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 552609 - DNA, 512 bp, Homo sapiens
  misc_feature: HIJSMM301ELNIF.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggcctcgggaccaaacgtaggatatcaaacgaactagtggctgcaccactctcgtcttcta

SEQ ID NO: 552610 - DNA, 486 bp, Homo sapiens
  misc_feature: HIJSMM301BH6B2.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccgaaagtggacgtcaaacgaactgtggctgcacca

SEQ ID NO: 552611 - DNA, 497 bp, Homo sapiens; identical to SEQ ID NO: 536376
  misc_feature: HIJSMM301EFAWG.22.9.A09.1.454.light.4.raw

SEQ ID NO: 552612 - DNA, 496 bp, Homo sapiens; identical to SEQ ID NO: 535541
  misc_feature: HIJSMM301ALD0J.3.33.C11.1.454.light.4.raw

SEQ ID NO: 552613 - DNA, 513 bp, Homo sapiens; identical to SEQ ID NO: 535719
  misc_feature: HIJSMM301APMJ5.17.33.C11.1.454.light.4.raw

SEQ ID NO: 552614 - DNA, 491 bp, Homo sapiens
  misc_feature: HIJSMM301AKXI4.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcat

SEQ ID NO: 552615 - DNA, 487 bp, Homo sapiens; identical to SEQ ID NO: 536206
  misc_feature: HIJSMM301AEMH5.47.38.D05.1.454.light.4.raw

SEQ ID NO: 552616 - DNA, 510 bp, Homo sapiens
  misc_feature: HIJSMM301AWPB4.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctcccggtccgaggatgaggctgattattactgtgcaccgtgggatgacatcctgaatggtccggtgttcggcggagggaccaggctgaccgtcctaatcagcccaaggctgcccccctc

SEQ ID NO: 552617 - DNA, 490 bp, Homo sapiens
  misc_feature: HIJSMM301AMMGN.51.85.H08.1.454.light.4.raw
cgatcgtatacacgaccggtgctcgatttagtatcactcagtcgcgggagacaggactcaggacaatctccagcatggccagcttccctctcctcctcaccctcctcactcactgtgcagggtcctgggcccagtctgtcctgactcagccaccctcagcgtctgggacccccgggcggagggtcgccatctcttgttctggaagcagctccaacatcggaagtaatgctgtcaactggtatcaacaactcccaggatcggcccccagactcctcatttttaataatgatcagcgggcctcaggggtccctgaccgattctctgcctccaagtcaggcacctcagcctccctggccatcagtgggctccagtctgaggatgaggctgattattattgtgcagcgtgggatgacagcctgtatatgtctctcttcggaggaggcacccagctgaccgtcctcggtcagcccaaggctgccccctggtcact

SEQ ID NO: 552618 - DNA, 472 bp, Homo sapiens; identical to SEQ ID NO: 536302
  misc_feature: HIJSMM301C40V9.18.76.G10.1.454.light.4.raw

SEQ ID NO: 552619 - DNA, 497 bp, Homo sapiens; identical to SEQ ID NO: 536371
  misc_feature: HIJSMM301D6E0J.16.78.H01.1.454.light.4.raw

SEQ ID NO: 552620 - DNA, 486 bp, Homo sapiens; identical to SEQ ID NO: 535458
  misc_feature: HIJSMM301CLJ0H.7.75.G09.1.454.light.4.raw

SEQ ID NO: 552621 - DNA, 441 bp, Homo sapiens; identical to SEQ ID NO: 534971
  misc_feature: HIJSMM301EM4YV.11.3.A03.1.454.light.4.raw

SEQ ID NO: 552622 - DNA, 495 bp, Homo sapiens
  misc_feature: HIJSMM301C9BMM.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatttcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagcccaaggccaacccactgtcact

SEQ ID NO: 552623 - DNA, 508 bp, Homo sapiens
  misc_feature: HIJSMM301DU54G.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 552624 - DNA, 488 bp, Homo sapiens; identical to SEQ ID NO: 535081
  misc_feature: HIJSMM301D97R4.26.23.C01.1.454.light.4.raw

SEQ ID NO: 552625 - DNA, 496 bp, Homo sapiens; identical to SEQ ID NO: 535109
  misc_feature: HIJSMM301AMC1T.16.78.H01.1.454.light.4.raw

SEQ ID NO: 552626 - DNA, 444 bp, Homo sapiens
  misc_feature: HIJSMM301ERMZX.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattgataccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 552627 - DNA, 483 bp, Homo sapiens; identical to SEQ ID NO: 539682
  misc_feature: HIJSMM301AO02T.49.28.C06.1.454.light.4.raw

SEQ ID NO: 552628 - DNA, 495 bp, Homo sapiens
  misc_feature: HIJSMM301EDA8E.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaagtctggcacctcagcctccctggccatcagtgggctccagtctgaggatgaggctgattattactgtgcatcatggactgacaccctgactggtccgggagtgttcggcggagggaccaagctgaccgtcctaggtcagcccaaggcagccccctcggtca

SEQ ID NO: 552629 - DNA, 499 bp, Homo sapiens
  misc_feature: HIJSMM301EC14M.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcacagcactctcatcgttcgtacgacgtcggaacaggtccaccgtccgtaggtcacgaccacgga

SEQ ID NO: 552630 - DNA, 504 bp, Homo sapiens
  misc_feature: HIJSMM301BZOTW.19.78.H01.1.454.light.4.raw
  modified_base (498)..(498): a, c, t, g, unknown or other
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccnctgtca

SEQ ID NO: 552631 - DNA, 481 bp, Homo sapiens
  misc_feature: HIJSMM301B9PZL.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcactcagcctccctggtcatcgctgggctccaggctgacgatgaggctgattattattgccagtcctatgacaacaccctgcgtggtttttggctgttcggcggcgggacc

SEQ ID NO: 552632 - DNA, 505 bp, Homo sapiens; identical to SEQ ID NO: 535503
  misc_feature: HIJSMM301CZ2OV.8.28.C06.1.454.light.4.raw

SEQ ID NO: 552633 - DNA, 486 bp, Homo sapiens
  misc_feature: HIJSMM301DJ1HH.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtcgtgggacagagttcactctcactatcagcggcctgcagcctgaagattctgcaacttattactgtctccagtatgatgcttaccctcggactttcggccaaggaccaaggtaggaaatacaaacgaactgtggctgcaccta

SEQ ID NO: 552634 - DNA, 444 bp, Homo sapiens; identical to SEQ ID NO: 538511
  misc_feature: HIJSMM301B77X4.5.9.A09.1.454.light.4.raw
  modified_base (426)..(426): a, c, t, g, unknown or other

SEQ ID NO: 552635 - DNA, 513 bp, Homo sapiens
  misc_feature: HIJSMM301B2ITD.43.67.G01.1.454.light.4.raw
tgtgagtagtcacgaccggtgctcgatttagagtatacatattgggtttgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaattcgttatactccgccgacgttcgccggggaccgaccgta

SEQ ID NO: 552636 - DNA, 497 bp, Homo sapiens; identical to SEQ ID NO: 535740
  misc_feature: HIJSMM301C2N90.3.71.G05.1.454.light.4.raw

SEQ ID NO: 552637 - DNA, 488 bp, Homo sapiens; identical to SEQ ID NO: 535861
  misc_feature: HIJSMM301BV5TZ.14.55.E11.1.454.light.4.raw

SEQ ID NO: 552638 - DNA, 444 bp, Homo sapiens; identical to SEQ ID NO: 539971
  misc_feature: HIJSMM301AG53Y.8.73.G07.1.454.light.4.raw
  modified_base (426)..(426): a, c, t, g, unknown or other

SEQ ID NO: 552639 - DNA, 454 bp, Homo sapiens; identical to SEQ ID NO: 534964
  misc_feature: HIJSMM301EN5H6.19.86.H09.1.454.light.4.raw

SEQ ID NO: 552640 - DNA, 492 bp, Homo sapiens
  misc_feature: HIJSMM301AW6FP.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccccg

SEQ ID NO: 552641 - DNA, 494 bp, Homo sapiens; identical to SEQ ID NO: 534992
  misc_feature: HIJSMM301AVUZD.9.1.A01.1.454.light.4.raw

SEQ ID NO: 552642 - DNA, 486 bp, Homo sapiens; identical to SEQ ID NO: 537144
  misc_feature: HIJSMM301D5I12.46.35.D02.1.454.light.4.raw

SEQ ID NO: 552643 - DNA, 481 bp, Homo sapiens
  misc_feature: HIJSMM301C1ZPT.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagatttgcaacttattactgtcaacaggtttatatttaccctcgtattttcggcccttgggaccacagtagatatcaaacgaactgtggctgcaccat

SEQ ID NO: 552644 - DNA, 496 bp, Homo sapiens
  misc_feature: HIJSMM301C9U1S.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgcat

SEQ ID NO: 552645 - DNA, 485 bp, Homo sapiens; identical to SEQ ID NO: 536210
  misc_feature: HIJSMM301DGSLX.43.54.E10.1.454.light.4.raw

SEQ ID NO: 552646 - DNA, 496 bp, Homo sapiens; identical to SEQ ID NO: 535541
  misc_feature: HIJSMM301DFTR9.3.33.C11.1.454.light.4.raw

SEQ ID NO: 552647 - DNA, 490 bp, Homo sapiens
  misc_feature: HIJSMM301DQFV2.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagaccaaacgaactgtggctgcaccatctgtcttcatt

SEQ ID NO: 552648 - DNA, 505 bp, Homo sapiens; identical to SEQ ID NO: 536117
  misc_feature: HIJSMM301ASI05.8.71.G05.1.454.light.4.raw

SEQ ID NO: 552649 - DNA, 373 bp, Homo sapiens; identical to SEQ ID NO: 537212
  misc_feature: HIJSMM301BTTJ3.21.25.C03.1.454.light.4.raw

SEQ ID NO: 552650 - DNA, 499 bp, Homo sapiens
  misc_feature: HIJSMM301AXBHQ.51.87.H10.1.454.light.4.raw
cgatcgtatacacgaccggtgctcgatttagcagtactgcgttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtggggtcccatcaaggttcagcggcggtggctctgggacagaattcactctcaccatcaccagcctgcagcctgatgattttgcaacttattactgccaacagtattatagttattggacgttcggccaagggaccaaggtggaatacaaacgaactgtggctgcaccatctgtcttcatcttccccg

SEQ ID NO: 552651 - DNA, 498 bp, Homo sapiens; identical to SEQ ID NO: 547944
  misc_feature: HIJSMM301C7QOO.41.53.E09.1.454.light.4.raw

SEQ ID NO: 552652 - DNA, 482 bp, Homo sapiens
  misc_feature: HIJSMM301D7060.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtaggagatcaaacgaactgtggctgcaccat

SEQ ID NO: 552653 - DNA, 489 bp, Homo sapiens
  misc_feature: HIJSMM301A5CPV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggacgaagacggagatcagacgaactgtggcgtgcaccactctgtcttcta

SEQ ID NO: 552654 - DNA, 507 bp, Homo sapiens
  misc_feature: HIJSMM301AH538.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaataacctggaagctgaagatgctgcaacttattactgtcatcagagtactactttacctcaagtgatcaccttcggccaagggacacgactggagattaaacgtaac

SEQ ID NO: 552655 - DNA, 520 bp, Homo sapiens
  misc_feature: HIJSMM301C7GX2.48.35.D02.1.454.light.4.raw
agtatacatacacgaccggtgctcgatttagcacacgatagttgggtttgggatttagatcgtctgtgttgggtttgggcttgatgccttggggtgggaggagagaccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccgccct

SEQ ID NO: 552656 - DNA, 487 bp, Homo sapiens; identical to SEQ ID NO: 538190
  misc_feature: HIJSMM301BIU9Z.47.70.G04.1.454.light.4.raw

SEQ ID NO: 552657 - DNA, 538 bp, Homo sapiens
  misc_feature: HIJSMM301C7Z1Q.17.75.G09.1.454.light.4.raw
  modified_base (497)..(497): a, c, t, g, unknown or other
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcggggcaagctgccctgaccctaacggggcgcagcctgaggacgaggccgactattattgcctactatcatttgatggtggtcgtctgcccattttcggcggcgggaccagggtggccgtcctgggtcagcccaaggctgccccctcggttaccnctcgttccgtcccctccctccctccgtactcgtctcgtagc

SEQ ID NO: 552658 - DNA, 444 bp, Homo sapiens; identical to SEQ ID NO: 536685
  misc_feature: HIJSMM301C2OAG.10.76.G10.1.454.light.4.raw

SEQ ID NO: 552659 - DNA, 456 bp, Homo sapiens
  misc_feature: HIJSMM301CP887.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctccctccaccgagagta

SEQ ID NO: 552660 - DNA, 491 bp, Homo sapiens; identical to SEQ ID NO: 535294
  misc_feature: HIJSMM301BXIUS.16.68.G02.1.454.light.4.raw

SEQ ID NO: 552661 - DNA, 486 bp, Homo sapiens; identical to SEQ ID NO: 535385
  misc_feature: HIJSMM301EA8S8.19.71.G05.1.454.light.4.raw

SEQ ID NO: 552662 - DNA, 498 bp, Homo sapiens
  misc_feature: HIJSMM301DT5X6.43.41.D08.1.454.light.4.raw
tgtgagtagtcacgaccggtgctcgatttagtcacgcgagaaagggaaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggcaagggaccaaggtggaaatcagacgaactgtggctgcacc

SEQ ID NO: 552663 - DNA, 504 bp, Homo sapiens; identical to SEQ ID NO: 538940
  misc_feature: HIJSMM301BGIPL.2.35.D02.1.454.light.4.raw

SEQ ID NO: 552664 - DNA, 513 bp, Homo sapiens
  misc_feature: HIJSMM301BHC2T.14.7.A07.1.454.light.4.raw
  modified_base (438)..(438): a, c, t, g, unknown or other
cgtctagtaccacgaccggtgctcgatttagcacgtgtcgcagggggccctgaggaaaacaaaccccagctgggaagcctgagaacacttagccttcatgagtgtccccacccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcacngtgcgttgtatatgggttttggcatttcggtgttcggcggagggacccaggtgaccgtcctacgtcagcccaagg

SEQ ID NO: 552665 - DNA, 488 bp, Homo sapiens
  misc_feature: HIJSMM301BTMOJ.16.72.G06.1.454.light.4.raw
tgtactactccacgaccggtgctcgatttagctacgactgcaagggaaagggggaggaactgctcagttaggacccagacggaaccatggaagccccagcgcagcttcacttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagatttgcagtttattactgtcagcagtataataactggcctccggtcactttcggcggagggaccaaggtggagatcaaacgaactgtggctgcaccat

SEQ ID NO: 552666 - DNA, 506 bp, Homo sapiens
  misc_feature: HIJSMM301CTM1Z.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtaccccccaccgtacggtcggacggacgaccacgtacgtacgagtacaaccgaaacgtacgtggtcgtcgcgaccactcttcg

SEQ ID NO: 552667 - DNA, 495 bp, Homo sapiens; identical to SEQ ID NO: 539267
  misc_feature: HIJSMM301EM183.21.27.C05.1.454.light.4.raw

SEQ ID NO: 552668 - DNA, 503 bp, Homo sapiens
  misc_feature: HIJSMM301DZ7LB.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatctttccgcc

SEQ ID NO: 552669 - DNA, 464 bp, Homo sapiens; identical to SEQ ID NO: 537111
  misc_feature: HIJSMM301DBM9C.17.28.C06.1.454.light.4.raw

SEQ ID NO: 552670 - DNA, 509 bp, Homo sapiens
  misc_feature: HIJSMM301ETLMQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaaactagtggcgtgcaccatctgtcttcatcttccccg

SEQ ID NO: 552671 - DNA, 510 bp, Homo sapiens
  misc_feature: HIJSMM301CZ8WE.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggctactcgcagtgacctctgcgtcttcggaagtgggaccaaggtcaccgtcttaggtcagcccaaggccaaccccactgtcactctgttcccaccct

SEQ ID NO: 552672 - DNA, 485 bp, Homo sapiens; identical to SEQ ID NO: 536307
  misc_feature: HIJSMM301BW717.46.35.D02.1.454.light.4.raw

SEQ ID NO: 552673 - DNA, 466 bp, Homo sapiens
  misc_feature: HIJSMM301CUSIV.3.68.G02.1.454.light.4.raw
agacgcactccacgaccggtgctcgatttagtcgatagtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtaccctccgacttttggccagggaccaagctggagatcaaacgaa

SEQ ID NO: 552674 - DNA, 479 bp, Homo sapiens
  misc_feature: HIJSMM301AUT3I.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccagggaccaaggtcgaaatgagacgaactgtggctgcacc

SEQ ID NO: 552675 - DNA, 476 bp, Homo sapiens
  misc_feature: HIJSMM301DETI0.3.1.A01.1.454.light.4.raw
agacgcactccacgaccggtgctcgatttagacgtctcatcaggggaggagtcagactcagtcaggacacagcatggacatgtgggtccccgctcagctcctggggctcctgctgctctggctcccaggtgccaaatgtgacagtccaagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacc

SEQ ID NO: 552676 - DNA, 502 bp, Homo sapiens; identical to SEQ ID NO: 538158
  misc_feature: HIJSMM301AYY0I.5.86.H09.1.454.light.4.raw

SEQ ID NO: 552677 - DNA, 447 bp, Homo sapiens; identical to SEQ ID NO: 535020
  misc_feature: HIJSMM301EGASU.18.9.A09.1.454.light.4.raw

SEQ ID NO: 552678 - DNA, 509 bp, Homo sapiens
  misc_feature: HIJSMM301CY4OE.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccat

SEQ ID NO: 552679 - DNA, 490 bp, Homo sapiens
  misc_feature: HIJSMM301DYHSZ.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacaatctctgggctccaggctgaggacgaggctgattattattgctgctcatatgcaggtcagcccaaggccaaccccactgtcactctgttcccaccctcctcactactcaca

SEQ ID NO: 552680 - DNA, 473 bp, Homo sapiens
  misc_feature: HIJSMM301DN79U.51.78.H01.1.454.light.4.raw
cgatcgtatacacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttacactgtcaacagagttacagtacccctcagctcactttcggcggagggaccgaaggtggagatcaaacgaaa

SEQ ID NO: 552681 - DNA, 512 bp, Homo sapiens
  misc_feature: HIJSMM301CO9Z4.48.57.F02.1.454.light.4.raw
agtatacatacacgaccggtgctcgatttagctcgatatagttgggtttggggggcgtcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgttctcaacagacaccagtgacaatcatgcgattttcggcggagggaccaagctgaccgtcctgggtcagcccaaggctgccccctcggtcactctgttcccgccctcct

SEQ ID NO: 552682 - DNA, 487 bp, Homo sapiens
  misc_feature: HIJSMM301DNEQZ.13.53.E09.1.454.light.4.raw
tcacgtactacacgaccggtgctcgatttagagagagtgtgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagatttgcaacttattactgtcaacagcttaatagttacccgctcagtttcggcggagggaccaaggtggagatcaaacgaactgtggctgcacatctgtt

SEQ ID NO: 552683 - DNA, 416 bp, Homo sapiens; identical to SEQ ID NO: 536892
  misc_feature: HIJSMM301CP69U.16.46.E02.1.454.light.4.raw

SEQ ID NO: 552684 - DNA, 486 bp, Homo sapiens
  misc_feature: HIJSMM301CPJOU.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctc

SEQ ID NO: 552685 - DNA, 486 bp, Homo sapiens; identical to SEQ ID NO: 537310
  misc_feature: HIJSMM301DEGVX.15.28.C06.1.454.light.4.raw

SEQ ID NO: 552686 - DNA, 488 bp, Homo sapiens; identical to SEQ ID NO: 541868
  misc_feature: HIJSMM301DXE9X.14.55.E11.1.454.light.4.raw

SEQ ID NO: 552687 - DNA, 485 bp, Homo sapiens; identical to SEQ ID NO: 536040
  misc_feature: HIJSMM301CU1HI.15.1.A01.1.454.light.4.raw

SEQ ID NO: 552688 - DNA, 487 bp, Homo sapiens; identical to SEQ ID NO: 536206
  misc_feature: HIJSMM301A7LM5.47.38.D05.1.454.light.4.raw

SEQ ID NO: 552689 - DNA, 503 bp, Homo sapiens
  misc_feature: HIJSMM301CNC62.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacccaaactgaccgtcctaggtcagcccaa

SEQ ID NO: 552690 - DNA, 496 bp, Homo sapiens
  misc_feature: HIJSMM301CWSSY.10.63.F08.1.454.light.4.raw
catagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagattttgcactttatttctgtcaccagagtcgcaactggcctccgacgttcggccaggggaccaaggtggagatcagacgaactgtggctgcaccatctgtcttcatcttctcc

SEQ ID NO: 552691 - DNA, 482 bp, Homo sapiens
  misc_feature: HIJSMM301BCAX1.40.83.H06.1.454.light.4.raw
tctagcgactcacgaccggtgctcgatttagatcacgtgcgtcgcggggtccaaacagagcttcagcaagcatagtgggaatctgcatcatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggaggaccaaactgtccgtcctaggtcacg

SEQ ID NO: 552692 - DNA, 488 bp, Homo sapiens; identical to SEQ ID NO: 538291
  misc_feature: HIJSMM301DQDIX.19.71.G05.1.454.light.4.raw

SEQ ID NO: 552693 - DNA, 313 bp, Homo sapiens
  misc_feature: HIJSMM301C6JHJ.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggat

SEQ ID NO: 552694 - DNA, 486 bp, Homo sapiens; identical to SEQ ID NO: 536261
  misc_feature: HIJSMM301AI51G.26.55.E11.1.454.light.4.raw

SEQ ID NO: 552695 - DNA, 510 bp, Homo sapiens
  misc_feature: HIJSMM301DAIUQ.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaacgccccctaaacttttggtttatcagggcaataagcggccctcaggggtttctaatcgcttctctggctccaagtctggcaacacggccgccctgacaatctctgggctccaggctgacgacgaggctgattttactgctgctcatatgcaggtgatcacacttttatgttcgggactgggaccaaggtcaccgtcctaggtcagcccaaggccaacccactgtcactctcg

SEQ ID NO: 552696 - DNA, 466 bp, Homo sapiens
  misc_feature: HIJSMM301B77YU.51.8.A08.1.454.light.4.raw
cgatcgtatacacgaccggtgctcgatttagcatactctacagggggcaggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatctaggttcagcggcagtggatctgggacagaattcactctcacaatcagcagcctgcagcctgaagattttgcaacttattactgtcaacagcacacttttggccaggggaccaagctggagatcaaacgaactgtggctgcaccat

SEQ ID NO: 552697 - DNA, 490 bp, Homo sapiens; identical to SEQ ID NO: 535526
  misc_feature: HIJSMM301AGEI3.26.78.H01.1.454.light.4.raw

SEQ ID NO: 552698 - DNA, 496 bp, Homo sapiens
  misc_feature: HIJSMM301AM771.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcgcgacggaccgaacggtaggaagtacaaacgaactagtggcgtcgcaccatctgtt

SEQ ID NO: 552699 - DNA, 493 bp, Homo sapiens; identical to SEQ ID NO: 535047
  misc_feature: HIJSMM301BXOW4.16.53.E09.1.454.light.4.raw

SEQ ID NO: 552700 - DNA, 473 bp, Homo sapiens; identical to SEQ ID NO: 535262
  misc_feature: HIJSMM301EGJU8.8.67.G01.1.454.light.4.raw

SEQ ID NO: 552701 - DNA, 502 bp, Homo sapiens; identical to SEQ ID NO: 544940
  misc_feature: HIJSMM301BJO87.9.53.E09.1.454.light.4.raw

SEQ ID NO: 552702 - DNA, 447 bp, Homo sapiens; identical to SEQ ID NO: 535882
  misc_feature: HIJSMM301D7ATE.18.9.A09.1.454.light.4.raw
  modified_base (429)..(429): a, c, t, g, unknown or other

SEQ ID NO: 552703 - DNA, 496 bp, Homo sapiens; identical to SEQ ID NO: 535109
  misc_feature: HIJSMM301AKAR3.16.78.H01.1.454.light.4.raw

SEQ ID NO: 552704 - DNA, 491 bp, Homo sapiens; identical to SEQ ID NO: 536211
  misc_feature: HIJSMM301DHLD8.16.53.E09.1.454.light.4.raw

SEQ ID NO: 552705 - DNA, 516 bp, Homo sapiens
  misc_feature: HIJSMM301B8I25.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggcctacgtttccggcccgtcgggaccgaaagtggatatacaaaccgaacgtgtggctgcaccatctgtt

SEQ ID NO: 552706 - DNA, 484 bp, Homo sapiens; identical to SEQ ID NO: 535400
  misc_feature: HIJSMM301BWK88.46.26.C04.1.454.light.4.raw

SEQ ID NO: 552707 - DNA, 514 bp, Homo sapiens
  misc_feature: HIJSMM301B1K2T.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcaacagagcccaagacggggatgaggctgactattattgttactctgcggctgacaaccatctggtttcggtcgggggaccgaagtgacgtcgtggtcgagcccaaggctgcccctccggtcactctgttcccgtccctcct

SEQ ID NO: 552708 - DNA, 516 bp, Homo sapiens
  misc_feature: HIJSMM301A5DJT.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtccactctgttcccaccctcctcg

SEQ ID NO: 552709 - DNA, 489 bp, Homo sapiens
  misc_feature: HIJSMM301BDLF9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgtcgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 552710 - DNA, 502 bp, Homo sapiens; identical to SEQ ID NO: 538158
  misc_feature: HIJSMM301BXWE5.5.86.H09.1.454.light.4.raw

SEQ ID NO: 552711 - DNA, 440 bp, Homo sapiens; identical to SEQ ID NO: 542294
  misc_feature: HIJSMM301EFNKG.11.3.A03.1.454.light.4.raw

SEQ ID NO: 552712 - DNA, 515 bp, Homo sapiens
  misc_feature: HIJSMM301AWQ9S.14.55.E11.1.454.light.4.raw
  modified_base (457)..(457): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctctacgttcggacgggacggaacgacggnggagactacgacgaacgaacgttggtcggtcgtcgaccaacctacttcgttcttcttt

SEQ ID NO: 552713 - DNA, 526 bp, Homo sapiens
  misc_feature: HIJSMM301C7JQY.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggcgtggtgataatgatcatgcgggggtggttcgggcgggagggaccgaaaggactgaccggtcctaacgtacagaccaacggacgtgcccctcccggtcgtcctctccg

SEQ ID NO: 552714 - DNA, 480 bp, Homo sapiens
  misc_feature: HIJSMM301AOR3H.48.68.G02.1.454.light.4.raw
agtatacatacacgaccggtgctcgatttagtcgatagtgaagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcctaggt

SEQ ID NO: 552715 - DNA, 443 bp, Homo sapiens
  misc_feature: HIJSMM301DN4NW.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccaccctcctccatactcgta

SEQ ID NO: 552716 - DNA, 499 bp, Homo sapiens
  misc_feature: HIJSMM301A2CYS.48.72.G06.1.454.light.4.raw
agtatacatacacgaccggtgctcgatttagctacgactgcaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgt

SEQ ID NO: 552717 - DNA, 492 bp, Homo sapiens
  misc_feature: HIJSMM301EPQN6.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttactcaagtgatcaccttcggccaagggacacgactggagattaaacgaactgtggctgcaccatctgtctt

SEQ ID NO: 552718 - DNA, 470 bp, Homo sapiens; identical to SEQ ID NO: 547523
  misc_feature: HIJSMM301B4QGI.5.28.C06.1.454.light.4.raw

SEQ ID NO: 552719 - DNA, 512 bp, Homo sapiens
  misc_feature: HIJSMM301EQ2ZH.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 552720 - DNA, 509 bp, Homo sapiens; identical to SEQ ID NO: 541829
  misc_feature: HIJSMM301EJ13E.17.28.C06.1.454.light.4.raw

SEQ ID NO: 552721 - DNA, 478 bp, Homo sapiens
  misc_feature: HIJSMM301AE8VD.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtcggatctgggacagatttcactctcaccatccgcagtctgcaacctgaagattttgcaatttattactgtcaagagactcacaatggaggcacttttggccaggggaccaagctggagaggaaacgaactgtggctgcaccat

SEQ ID NO: 552722 - DNA, 488 bp, Homo sapiens
  misc_feature: HIJSMM301CAZ7Z.17.35.D02.1.454.light.4.raw
cgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtt

SEQ ID NO: 552723 - DNA, 494 bp, Homo sapiens; identical to SEQ ID NO: 534994
  misc_feature: HIJSMM301BKE2I.27.78.H01.1.454.light.4.raw

SEQ ID NO: 552724 - DNA, 498 bp, Homo sapiens
  misc_feature: HIJSMM301CPQ6M.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtgaccgtcctaggtcagcccaagg

SEQ ID NO: 552725 - DNA, 489 bp, Homo sapiens
  misc_feature: HIJSMM301EX2A3.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcctgatgattttgcaacttattactgccaacattacaatgattactcgcgtacgttcggccaagggaccagggtggaaatcaaacgaactgtggctgcaccatctgtcttc

SEQ ID NO: 552726 - DNA, 486 bp, Homo sapiens; identical to SEQ ID NO: 544298
  misc_feature: HIJSMM301E13M7.40.83.H06.1.454.light.4.raw

SEQ ID NO: 552727 - DNA, 488 bp, Homo sapiens; identical to SEQ ID NO: 542120
  misc_feature: HIJSMM301AX5PI.47.38.D05.1.454.light.4.raw

SEQ ID NO: 552728 - DNA, 477 bp, Homo sapiens
  misc_feature: HIJSMM301CW12K.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagacccg

SEQ ID NO: 552729 - DNA, 484 bp, Homo sapiens; identical to SEQ ID NO: 551212
  misc_feature: HIJSMM301DPBFI.3.10.A10.1.454.light.4.raw

SEQ ID NO: 552730 - DNA, 493 bp, Homo sapiens; identical to SEQ ID NO: 535047
  misc_feature: HIJSMM301AZ96F.16.53.E09.1.454.light.4.raw

SEQ ID NO: 552731 - DNA, 513 bp, Homo sapiens
  misc_feature: HIJSMM301D80JG.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggccccaggcagatgatgaatctgtttattattgtgtcctatatatgggtgctggcatttcggtcttcggcggagggaccaagctgaccgtcctta

SEQ ID NO: 552732 - DNA, 500 bp, Homo sapiens
  misc_feature: HIJSMM301CEDUV.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaagtggagatcaacgaactgtggctgcacca

SEQ ID NO: 552733 - DNA, 491 bp, Homo sapiens
  misc_feature: HIJSMM301B0VQ1.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggtccaggggaccgaagctggagatcaggcgtaacg

SEQ ID NO: 552734 - DNA, 516 bp, Homo sapiens
  misc_feature: HIJSMM301CAFZ8.53.20.B09.1.454.light.4.raw
cgcgtatacacacgaccggtgctcgatttagtgtagtgtgaagggcgtgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccaccctcctctcgta

SEQ ID NO: 552735 - DNA, 503 bp, Homo sapiens
  misc_feature: HIJSMM301DHE3B.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtctacgtcagcccaaggccaactccactgtcatt

SEQ ID NO: 552736 - DNA, 486 bp, Homo sapiens; identical to SEQ ID NO: 535385
  misc_feature: HIJSMM301EG6H8.19.71.G05.1.454.light.4.raw

SEQ ID NO: 552737 - DNA, 484 bp, Homo sapiens; identical to SEQ ID NO: 535211
  misc_feature: HIJSMM301B84IG.47.46.E02.1.454.light.4.raw

SEQ ID NO: 552738 - DNA, 478 bp, Homo sapiens
  misc_feature: HIJSMM301AHU1W.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgtcgccgaaggaccgaaggtggaaatacaaacgaactagtggctgcaccat

SEQ ID NO: 552739 - DNA, 494 bp, Homo sapiens
  misc_feature: HIJSMM301EU5YD.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaaggctgaccgtcctgggtcagcccaaggctgcccctcggtcact

SEQ ID NO: 552740 - DNA, 505 bp, Homo sapiens
  misc_feature: HIJSMM301ESDK2.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcggagggaccaaaactgaccgtcctaggtcaggcccaa

SEQ ID NO: 552741 - DNA, 495 bp, Homo sapiens; identical to SEQ ID NO: 535596
  misc_feature: HIJSMM301A1EG1.10.79.H02.1.454.light.4.raw

SEQ ID NO: 552742 - DNA, 493 bp, Homo sapiens; identical to SEQ ID NO: 536296
  misc_feature: HIJSMM301BVGFC.5.48.E04.1.454.light.4.raw

SEQ ID NO: 552743 - DNA, 354 bp, Homo sapiens; identical to SEQ ID NO: 535026
  misc_feature: HIJSMM301DZWY3.19.22.B11.1.454.light.4.raw

SEQ ID NO: 552744 - DNA, 495 bp, Homo sapiens
  misc_feature: HIJSMM301CCH0B.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaaggaccgaacggtggaagtacaaacgaactagtggctgcaccatctgtctt

SEQ ID NO: 552745 - DNA, 478 bp, Homo sapiens
  misc_feature: HIJSMM301DCA55.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtattcggcggggggacccac

SEQ ID NO: 552746 - DNA, 492 bp, Homo sapiens
  misc_feature: HIJSMM301BY01G.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcccgatgattttgcaacttattactgccaacattacaatgattactcgcgtacgttcggccaagggaccagggtggaaatcaaacgaactgtggctgcaccatctgtcttcatt

SEQ ID NO: 552747 - DNA, 496 bp, Homo sapiens
  misc_feature: HIJSMM301DCXLG.41.14.B03.1.454.light.4.raw
tctatactatcacgaccggtgctcgatttagtgtgagtagttccgcggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggatggaccaagctgaccgtcctaggtcagcccaaggctcg

SEQ ID NO: 552748 - DNA, 500 bp, Homo sapiens
  misc_feature: HIJSMM301D8F82.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggccagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactctgttcccccg

SEQ ID NO: 552749 - DNA, 508 bp, Homo sapiens
  misc_feature: HIJSMM301BWNIL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacggaccgaaggtaggaaagtcaaacgaactagtggctgcaccatctgtcttctatcttccccg

SEQ ID NO: 552750 - DNA, 483 bp, Homo sapiens; identical to SEQ ID NO: 540738
  misc_feature: HIJSMM301ASIZ3.48.85.H08.1.454.light.4.raw

SEQ ID NO: 552751 - DNA, 485 bp, Homo sapiens
  misc_feature: HIJSMM301DAD8V.41.37.D04.1.454.light.4.raw
tctatactatcacgaccggtgctcgatttagtagcatactgttgggtttggggtctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggt

SEQ ID NO: 552752 - DNA, 434 bp, Homo sapiens
  misc_feature: HIJSMM301E2D43.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggtccagggaccaagctggagatcaaacgaactgtggctgcaccatctgtcttcatcttcccgccatctgacatactcgta

SEQ ID NO: 552753 - DNA, 499 bp, Homo sapiens
  misc_feature: HIJSMM301CC0IU.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccaaggtaggaatacaaacgaactagtggctgcacc

SEQ ID NO: 552754 - DNA, 504 bp, Homo sapiens
  misc_feature: HIJSMM301CRBIB.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcac

SEQ ID NO: 552755 - DNA, 482 bp, Homo sapiens; identical to SEQ ID NO: 535796
  misc_feature: HIJSMM301EIO9U.51.64.F09.1.454.light.4.raw

SEQ ID NO: 552756 - DNA, 495 bp, Homo sapiens
  misc_feature: HIJSMM301AJ4L4.49.12.B01.1.454.light.4.raw
agtcgagagacacgaccggtgctcgatttagtagtgtagattccgcgggcacgaccggtgctcgatttagtatagacatcaacacacaaagggggcaggagtcagtctcagtcaggacccagcatggacatgagggtccccgctcagctcctggggctcctgctactctggctccgaggtgccagatgtgacatccagatgacccagtctccatcttccctgtctgcatctctgggagacagagtcaccatcacttgccaggcgagtcagaccattggcaactttttaaattggtatcaacacaaaccagggaaagcccctaaactcctgatctatgctgcatccactttgcaaagtggggtcccttcaaggttccgtggcggtggatctgggacagatttcgctctcaccatcagcagtctccagcctgaagattttgcgacttactactgtcaacagagtttctctgacctcacttttcggcggagggaccac

SEQ ID NO: 552757 - DNA, 511 bp, Homo sapiens
  misc_feature: HIJSMM301AN0LM.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactagtggctgcaccactctgtcttcta

SEQ ID NO: 552758 - DNA, 501 bp, Homo sapiens
  misc_feature: HIJSMM301CJI3Y.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggcactctgttcccaccctcctcg

SEQ ID NO: 552759 - DNA, 498 bp, Homo sapiens
  misc_feature: HIJSMM301BLW1A.48.31.C09.1.454.light.4.raw
agtatacatacacgaccggtgctcgatttagacgtctcatcaaggaaggaaggggagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccg

SEQ ID NO: 552760 - DNA, 486 bp, Homo sapiens; identical to SEQ ID NO: 535043
  misc_feature: HIJSMM301DM3HW.46.35.D02.1.454.light.4.raw

SEQ ID NO: 552761 - DNA, 504 bp, Homo sapiens; identical to SEQ ID NO: 535128
  misc_feature: HIJSMM301A66AE.19.85.H08.1.454.light.4.raw

SEQ ID NO: 552762 - DNA, 521 bp, Homo sapiens; identical to SEQ ID NO: 539470
  misc_feature: HIJSMM301A3742.27.23.C01.1.454.light.4.raw

SEQ ID NO: 552763 - DNA, 501 bp, Homo sapiens; identical to SEQ ID NO: 548645
  misc_feature: HIJSMM301A5P2T.14.23.C01.1.454.light.4.raw

SEQ ID NO: 552764 - DNA, 509 bp, Homo sapiens
  misc_feature: HIJSMM301CFEOD.9.12.B01.1.454.light.4.raw
  modified_base (492)..(492): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacaaaacgaactagtggctgcaccaanctgtcttcatctccccg

SEQ ID NO: 552765 - DNA, 511 bp, Homo sapiens; identical to SEQ ID NO: 548439
  misc_feature: HIJSMM301A13J1.16.46.E02.1.454.light.4.raw

SEQ ID NO: 552766 - DNA, 493 bp, Homo sapiens; identical to SEQ ID NO: 537239
  misc_feature: HIJSMM301C8ZKH.49.66.F11.1.454.light.4.raw

SEQ ID NO: 552767 - DNA, 434 bp, Homo sapiens; identical to SEQ ID NO: 535153
  misc_feature: HIJSMM301ERKKW.18.5.A05.1.454.light.4.raw

SEQ ID NO: 552768 - DNA, 486 bp, Homo sapiens
  misc_feature: HIJSMM301DH37M.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactagtggctgcaccactctgtcttcatcttcccgtccatctgactagttacg

SEQ ID NO: 552769 - DNA, 485 bp, Homo sapiens
  misc_feature: HIJSMM301CKZ4L.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttcctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 552770 - DNA, 508 bp, Homo sapiens
  misc_feature: HIJSMM301EV1ZJ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctcgccccctcggtccactctgttcccaccctcctctacgtcgtat

SEQ ID NO: 552771 - DNA, 519 bp, Homo sapiens
  misc_feature: HIJSMM301AJBN0.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccgacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacctttcggcccgtcgggtaccgaaacgtaggagtatacaaacgaaactagtggcgtcgcaccactctgtt

SEQ ID NO: 552772 - DNA, 512 bp, Homo sapiens; identical to SEQ ID NO: 552719
  misc_feature: HIJSMM301C3LUM.22.36.D03.1.454.light.4.raw

SEQ ID NO: 552773 - DNA, 509 bp, Homo sapiens; identical to SEQ ID NO: 539359
  misc_feature: HIJSMM301CYS3M.47.85.H08.1.454.light.4.raw

SEQ ID NO: 552774 - DNA, 488 bp, Homo sapiens
  misc_feature: HIJSMM301DTHV3.47.38.D05.1.454.light.4.raw
  modified_base (472)..(472): a, c, t, g, unknown or other
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccgaanctggagatcaaacgaa

SEQ ID NO: 552775 - DNA, 482 bp, Homo sapiens; identical to SEQ ID NO: 535216
  misc_feature: HIJSMM301BJQRR.17.26.C04.1.454.light.4.raw

SEQ ID NO: 552776 - DNA, 479 bp, Homo sapiens
  misc_feature: HIJSMM301A9FK4.16.86.H09.1.454.light.4.raw
tgtactactccacgaccggtgctcgatttagtgctatagacttgggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 552777 - DNA, 413 bp, Homo sapiens
  misc_feature: HIJSMM301B9XMA.16.46.E02.1.454.light.4.raw
tgtactactccacgaccggtgctcgatttagactcatctacagggaaaggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtctaggtcagcccaaggccaacccactgtcactctgttcccgccctcctcgagtagtaca

SEQ ID NO: 552778 - DNA, 501 bp, Homo sapiens; identical to SEQ ID NO: 535873
  misc_feature: HIJSMM301APG5N.17.27.C05.1.454.light.4.raw

SEQ ID NO: 552779 - DNA, 499 bp, Homo sapiens
  misc_feature: HIJSMM301BI0GB.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctcgaccatctctggctccaggctgaagacgaggctgattattactgcagctcatatacaggcagcagcactcaggttttcggcggagggaccaagctgaccgtcctaggtcagcccaaggctcgccccctcggt

SEQ ID NO: 552780 - DNA, 497 bp, Homo sapiens; identical to SEQ ID NO: 536371
  misc_feature: HIJSMM301BLDFP.16.78.H01.1.454.light.4.raw

SEQ ID NO: 552781 - DNA, 503 bp, Homo sapiens; identical to SEQ ID NO: 546983
  misc_feature: HIJSMM301AQZ7X.21.22.B11.1.454.light.4.raw

SEQ ID NO: 552782 - DNA, 493 bp, Homo sapiens; identical to SEQ ID NO: 537281
  misc_feature: HIJSMM301AGADK.9.1.A01.1.454.light.4.raw

SEQ ID NO: 552783 - DNA, 472 bp, Homo sapiens
  misc_feature: HIJSMM301BCE0R.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaccagggaaagccctaagctcctgatctacgatgcatctaagttggaacaggggtctcatcaaggttcagtggaagtggatctgggacagatcctactttcaccatcagcagcctgcagccagaagatattgcgacatatttctgtcaggtgtatgaaagtctccctgttttggtccaggggaccaaggtggagatcaaacgaactagtggctgcaccat

SEQ ID NO: 552784 - DNA, 487 bp, Homo sapiens
  misc_feature: HIJSMM301EK0I2.5.6.A06.1.454.light.4.raw
atcagacacgcacgaccggtgctcgatttagatctactgacagggggagtcagacccagtcaggacacagcatggacatgagggtccccgctcagctcctgggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactagtggctgcaccatctgtcttcta

SEQ ID NO: 552785 - DNA, 512 bp, Homo sapiens; identical to SEQ ID NO: 539813
  misc_feature: HIJSMM301BW3JO.14.7.A07.1.454.light.4.raw

SEQ ID NO: 552786 - DNA, 479 bp, Homo sapiens
  misc_feature: HIJSMM301COOOM.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcgccagggaccgaaagtaggagtgtcaaccgaacctagttggctg

SEQ ID NO: 552787 - DNA, 470 bp, Homo sapiens
  misc_feature: HIJSMM301AEMJJ.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgattttgctctccgagtgccacttttgcggggggaccgaaggtggacatcaaacgaa

SEQ ID NO: 552788 - DNA, 487 bp, Homo sapiens
  misc_feature: HIJSMM301CL34G.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggccaaggtggagatcaaacgaactgtggctgcaccatct

SEQ ID NO: 552789 - DNA, 507 bp, Homo sapiens; identical to SEQ ID NO: 536086
  misc_feature: HIJSMM301A5X1K.12.73.G07.1.454.light.4.raw

SEQ ID NO: 552790 - DNA, 502 bp, Homo sapiens
  misc_feature: HIJSMM301D0MEO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaaggaccaaggtggaaagtcaaacgaaacctgtggctgcacc

SEQ ID NO: 552791 - DNA, 482 bp, Homo sapiens
  misc_feature: HIJSMM301DDG26.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagatcagacgaactgt

SEQ ID NO: 552792 - DNA, 489 bp, Homo sapiens; identical to SEQ ID NO: 535139
  misc_feature: HIJSMM301AECI1.14.55.E11.1.454.light.4.raw

SEQ ID NO: 552793 - DNA, 497 bp, Homo sapiens; identical to SEQ ID NO: 535286
  misc_feature: HIJSMM301EDDI1.18.59.F04.1.454.light.4.raw

SEQ ID NO: 552794 - DNA, 482 bp, Homo sapiens; identical to SEQ ID NO: 536622
  misc_feature: HIJSMM301DXC55.7.85.H08.1.454.light.4.raw

SEQ ID NO: 552795 - DNA, 508 bp, Homo sapiens
  misc_feature: HIJSMM301EU8MY.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccgaaggaccgaaggtggaagtcaagcgaactgtggctgcaccatctgtcttcatcttcccgcc

SEQ ID NO: 552796 - DNA, 506 bp, Homo sapiens; identical to SEQ ID NO: 543832
  misc_feature: HIJSMM301BTM34.11.57.F02.1.454.light.4.raw

SEQ ID NO: 552797 - DNA, 494 bp, Homo sapiens; identical to SEQ ID NO: 535276
  misc_feature: HIJSMM301EQLOH.16.6.A06.1.454.light.4.raw

SEQ ID NO: 552798 - DNA, 474 bp, Homo sapiens; identical to SEQ ID NO: 539713
  misc_feature: HIJSMM301A02O8.5.28.C06.1.454.light.4.raw

SEQ ID NO: 552799 - DNA, 521 bp, Homo sapiens; identical to SEQ ID NO: 539470
  misc_feature: HIJSMM301DFMT3.27.23.C01.1.454.light.4.raw

SEQ ID NO: 552800 - DNA, 502 bp, Homo sapiens; identical to SEQ ID NO: 541971
  misc_feature: HIJSMM301COIB8.4.39.D06.1.454.light.4.raw

SEQ ID NO: 552801 - DNA, 507 bp, Homo sapiens
  misc_feature: HIJSMM301BEN1H.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactcctgttcccacccct

SEQ ID NO: 552802 - DNA, 479 bp, Homo sapiens; identical to SEQ ID NO: 535665
  misc_feature: HIJSMM301CCKRD.12.10.A10.1.454.light.4.raw

SEQ ID NO: 552803 - DNA, 505 bp, Homo sapiens; identical to SEQ ID NO: 550885
  misc_feature: HIJSMM301DISHZ.18.78.H01.1.454.light.4.raw

SEQ ID NO: 552804 - DNA, 518 bp, Homo sapiens
  misc_feature: HIJSMM301AF13H.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacctttcggtcccgtcgggaccgaaacggtggagtatacaaacgaacctagtggcgtgcaccatctgtctt

SEQ ID NO: 552805 - DNA, 486 bp, Homo sapiens
  misc_feature: HIJSMM301BNAOF.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccc

SEQ ID NO: 552806 - DNA, 501 bp, Homo sapiens
  misc_feature: HIJSMM301BL1NM.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaatagaggtcaacgaactgtggctgcaccatctgtcttcat

SEQ ID NO: 552807 - DNA, 517 bp, Homo sapiens
  misc_feature: HIJSMM301A8YUI.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccta

SEQ ID NO: 552808 - DNA, 510 bp, Homo sapiens
  misc_feature: HIJSMM301ES9V6.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatggttgcggtttattactgcctgcagagtattcactggccgtggaccgttcggccgaagggaccgaaggtaggaaatacaaacgaacgtgtggcgtgcaccattc

SEQ ID NO: 552809 - DNA, 493 bp, Homo sapiens; identical to SEQ ID NO: 536471
  misc_feature: HIJSMM301A1XLX.3.71.G05.1.454.light.4.raw

SEQ ID NO: 552810 - DNA, 504 bp, Homo sapiens; identical to SEQ ID NO: 538940
  misc_feature: HIJSMM301C4HTU.2.35.D02.1.454.light.4.raw

SEQ ID NO: 552811 - DNA, 503 bp, Homo sapiens; identical to SEQ ID NO: 537189
  misc_feature: HIJSMM301BRR0W.19.85.H08.1.454.light.4.raw

SEQ ID NO: 552812 - DNA, 496 bp, Homo sapiens
  misc_feature: HIJSMM301ER2EU.51.27.C05.1.454.light.4.raw
cgatcgtatacacgaccggtgctcgatttagacgcgatcgaagggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 552813 - DNA, 488 bp, Homo sapiens
  misc_feature: HIJSMM301C55LK.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 552814 - DNA, 484 bp, Homo sapiens; identical to SEQ ID NO: 535240
  misc_feature: HIJSMM301CLL6Y.47.60.F05.1.454.light.4.raw

SEQ ID NO: 552815 - DNA, 481 bp, Homo sapiens
  misc_feature: HIJSMM301DDS7B.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtacaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtcttcta

SEQ ID NO: 552816 - DNA, 489 bp, Homo sapiens
  misc_feature: HIJSMM301BLWOL.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaagggaccaaggtggaaatcaaacgaactgtggctgcaccat

SEQ ID NO: 552817 - DNA, 480 bp, Homo sapiens
  misc_feature: HIJSMM301CTYYN.11.11.A11.1.454.light.4.raw
cgagagataccacgaccggtgctcgatttagctacgactgcaggggcagcaagatggtgttgcagacccaggtcttctatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcaggcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 552818 - DNA, 503 bp, Homo sapiens; identical to SEQ ID NO: 535044
  misc_feature: HIJSMM301EG72C.19.78.H01.1.454.light.4.raw

SEQ ID NO: 552819 - DNA, 487 bp, Homo sapiens; identical to SEQ ID NO: 546877
  misc_feature: HIJSMM301BA6Q7.41.44.D11.1.454.light.4.raw

SEQ ID NO: 552820 - DNA, 498 bp, Homo sapiens
  misc_feature: HIJSMM301BBNXJ.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaaccccactgtcactctgttcccaccctcctcgagtagtaca

SEQ ID NO: 552821 - DNA, 521 bp, Homo sapiens; identical to SEQ ID NO: 539470
  misc_feature: HIJSMM301DK2OP.27.23.C01.1.454.light.4.raw

SEQ ID NO: 552822 - DNA, 522 bp, Homo sapiens
  misc_feature: HIJSMM301DTU65.8.20.B09.1.454.light.4.raw
ctcgcgtgtccacgaccggtgctcgatttagtgtagtgtgaagggagcaccgtggagaagacagtggcccctacagaatgttcataggttctcatccctcaccccccaccacgggagactagagctgcaggatcccaggggaggggtctctcctcgctcactgcacagggtcctgggcccagtctgtgctgacgcagccgccctcagtgtctggggccccagggcagagggtcgccatttcctgcactgggacgagctccaacatcggggcaggttatgatgtacactggtaccggcacctcccaggagaagcccccaaactcttcatctggggtaacaccaatcggccctcaggggtccctgaccgagtctcaggctccaagtctggcacctcagcctccctggccgtctcggggctccaggctgaggatgagggtgattattactgcctgtcctatgacaacagcctgaatatatgggtgttcggcggagggaccaaactgaccgtcctcagtcagcccc

SEQ ID NO: 552823 - DNA, 488 bp, Homo sapiens; identical to SEQ ID NO: 535081
  misc_feature: HIJSMM301DNNN4.26.23.C01.1.454.light.4.raw

SEQ ID NO: 552824 - DNA, 487 bp, Homo sapiens; identical to SEQ ID NO: 539157
  misc_feature: HIJSMM301C2XJV.26.37.D04.1.454.light.4.raw

SEQ ID NO: 552825 - DNA, 517 bp, Homo sapiens
  misc_feature: HIJSMM301BY1KC.43.81.H04.1.454.light.4.raw
  modified_base (501)..(501): a, c, t, g, unknown or other
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagccaaggctgccccctcggtcactctgttcccnccctcctcactactca

SEQ ID NO: 552826 - DNA, 478 bp, Homo sapiens
  misc_feature: HIJSMM301AIDHG.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccctactttcggcggacggaccgaaggtggagatacaaacgaactgtgctgcaccatctgt

SEQ ID NO: 552827 - DNA, 496 bp, Homo sapiens; identical to SEQ ID NO: 536248
  misc_feature: HIJSMM301DMU1T.22.27.C05.1.454.light.4.raw

SEQ ID NO: 552828 - DNA, 502 bp, Homo sapiens
  misc_feature: HIJSMM301ETVQW.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcattcttcccgcca

SEQ ID NO: 552829 - DNA, 497 bp, Homo sapiens; identical to SEQ ID NO: 535664
  misc_feature: HIJSMM301BDOSD.22.14.B03.1.454.light.4.raw

SEQ ID NO: 552830 - DNA, 477 bp, Homo sapiens
  misc_feature: HIJSMM301C6DJV.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacatgctaacagtttccctttaatcttcggccaagggacacgactggagattaaacgaactgtgg

SEQ ID NO: 552831 - DNA, 471 bp, Homo sapiens
  misc_feature: HIJSMM301EJ8KW.49.49.E05.1.454.light.4.raw
agtcgagagacacgaccggtgctcgatttagagcgactagcaacacacaaaggggcagtcccaaccaggacacagcatggacatgagggtccctgctcagctcctggggctcctgctgctctggctctcaggtgccagatgtatcatccagatgacccagtctccatcctccgtgtctgcatttataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatcttccgctcactttcggcggagggaccaaggtggggatcagacgaactgt

SEQ ID NO: 552832 - DNA, 502 bp, Homo sapiens
  misc_feature: HIJSMM301A24PG.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggctgcaccatctgtctt

SEQ ID NO: 552833 - DNA, 492 bp, Homo sapiens; identical to SEQ ID NO: 537015
  misc_feature: HIJSMM301DTMM8.43.29.C07.1.454.light.4.raw

SEQ ID NO: 552834 - DNA, 505 bp, Homo sapiens
  misc_feature: HIJSMM301BFS9T.48.29.C07.1.454.light.4.raw
agtatacatacacgaccggtgctcgatttagagtgctacgaagggaaagggggagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccgccat

SEQ ID NO: 552835 - DNA, 494 bp, Homo sapiens; identical to SEQ ID NO: 534994
  misc_feature: HIJSMM301D6POZ.27.78.H01.1.454.light.4.raw

SEQ ID NO: 552836 - DNA, 504 bp, Homo sapiens; identical to SEQ ID NO: 538423
  misc_feature: HIJSMM301EE1BE.48.67.G01.1.454.light.4.raw

SEQ ID NO: 552837 - DNA, 500 bp, Homo sapiens; identical to SEQ ID NO: 544290
  misc_feature: HIJSMM301EEIXG.48.31.C09.1.454.light.4.raw

SEQ ID NO: 552838 - DNA, 511 bp, Homo sapiens
  misc_feature: HIJSMM301ALQT7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctcgttcccta

SEQ ID NO: 552839 - DNA, 490 bp, Homo sapiens; identical to SEQ ID NO: 541567
  misc_feature: HIJSMM301CKFRH.22.65.F10.1.454.light.4.raw

SEQ ID NO: 552840 - DNA, 485 bp, Homo sapiens; identical to SEQ ID NO: 536630
  misc_feature: HIJSMM301BSJI0.13.56.F01.1.454.light.4.raw

SEQ ID NO: 552841 - DNA, 493 bp, Homo sapiens; identical to SEQ ID NO: 536471
  misc_feature: HIJSMM301CWNFH.3.71.G05.1.454.light.4.raw

SEQ ID NO: 552842 - DNA, 502 bp, Homo sapiens; identical to SEQ ID NO: 541501
  misc_feature: HIJSMM301BY5P6.17.27.C05.1.454.light.4.raw

SEQ ID NO: 552843 - DNA, 485 bp, Homo sapiens
  misc_feature: HIJSMM301DBSTZ.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggccgcgacgttcggccaagggaccgaggtggaattcaaacgaactgtggctgcaccatctgtctt

SEQ ID NO: 552844 - DNA, 496 bp, Homo sapiens; identical to SEQ ID NO: 535541
  misc_feature: HIJSMM301C0PC1.3.33.C11.1.454.light.4.raw

SEQ ID NO: 552845 - DNA, 508 bp, Homo sapiens
  misc_feature: HIJSMM301DIXDN.5.24.C02.1.454.light.4.raw
  modified_base (499)..(499): a, c, t, g, unknown or other
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggcngtccccccg

SEQ ID NO: 552846 - DNA, 501 bp, Homo sapiens
  misc_feature: HIJSMM301A6L20.49.70.G04.1.454.light.4.raw
agtcgagagacacgaccggtgctcgatttagtgtagtgtgaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 552847 - DNA, 484 bp, Homo sapiens
  misc_feature: HIJSMM301ARI8L.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaactgtggatatcaaacgaactagtggctgcaccatctgtt

SEQ ID NO: 552848 - DNA, 513 bp, Homo sapiens; identical to SEQ ID NO: 535244
  misc_feature: HIJSMM301B2CZ8.17.33.C11.1.454.light.4.raw

SEQ ID NO: 552849 - DNA, 484 bp, Homo sapiens
  misc_feature: HIJSMM301BLC4E.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctccccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaacgaactgtggctgcaccat

SEQ ID NO: 552850 - DNA, 506 bp, Homo sapiens; identical to SEQ ID NO: 539926
  misc_feature: HIJSMM301DR3N0.5.24.C02.1.454.light.4.raw

SEQ ID NO: 552851 - DNA, 503 bp, Homo sapiens
  misc_feature: HIJSMM301ECXKE.49.27.C05.1.454.light.4.raw
agtcgagagacacgaccggtgctcgatttagacgcgatcgaagggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggtagggaccaggctgaccgtcctaggtcagcccaaggccaaccccactcgtcact

SEQ ID NO: 552852 - DNA, 463 bp, Homo sapiens; identical to SEQ ID NO: 535062
  misc_feature: HIJSMM301CLZPD.11.73.G07.1.454.light.4.raw

SEQ ID NO: 552853 - DNA, 486 bp, Homo sapiens; identical to SEQ ID NO: 535043
  misc_feature: HIJSMM301E0GAY.46.35.D02.1.454.light.4.raw

SEQ ID NO: 552854 - DNA, 490 bp, Homo sapiens
  misc_feature: HIJSMM301CG8V5.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttctcccg

SEQ ID NO: 552855 - DNA, 501 bp, Homo sapiens; identical to SEQ ID NO: 536818
  misc_feature: HIJSMM301ALWYM.12.82.H05.1.454.light.4.raw

SEQ ID NO: 552856 - DNA, 484 bp, Homo sapiens
  misc_feature: HIJSMM301A9ZUW.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgt

SEQ ID NO: 552857 - DNA, 519 bp, Homo sapiens
  misc_feature: HIJSMM301C8ABQ.9.2.A02.1.454.light.4.raw
tgatacgtctcacgaccggtgctcgatttagactcatctacaggggggggtcgtcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgtttgggtgttcggcggagggaccatgctgaccgtcctgagtcagcccaaggctgccccctcggtcactctgttcccaccct

SEQ ID NO: 552858 - DNA, 463 bp, Homo sapiens
  misc_feature: HIJSMM301CJ02A.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacgagtaagggggacggatccctgatcgcttctcaggctccagctctggggctgagcgctacctcaccatctccagcctccagtctgaggatgaggctgactattactgtcagaccgtgggcactggcaagtagtt

SEQ ID NO: 552859 - DNA, 493 bp, Homo sapiens
  misc_feature: HIJSMM301D736M.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggttcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcatt

SEQ ID NO: 552860 - DNA, 521 bp, Homo sapiens
  misc_feature: HIJSMM301B2VXD.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaacggccaaccccactcgtcactctgttcccaccctcctccgt

SEQ ID NO: 552861 - DNA, 493 bp, Homo sapiens; identical to SEQ ID NO: 536769
  misc_feature: HIJSMM301ATZ4J.19.83.H06.1.454.light.4.raw

SEQ ID NO: 552862 - DNA, 484 bp, Homo sapiens; identical to SEQ ID NO: 538870
  misc_feature: HIJSMM301BJM9O.11.76.G10.1.454.light.4.raw

SEQ ID NO: 552863 - DNA, 476 bp, Homo sapiens; identical to SEQ ID NO: 538611
  misc_feature: HIJSMM301C8S51.7.81.H04.1.454.light.4.raw

SEQ ID NO: 552864 - DNA, 489 bp, Homo sapiens; identical to SEQ ID NO: 536663
  misc_feature: HIJSMM301AN0IN.16.72.G06.1.454.light.4.raw

SEQ ID NO: 552865 - DNA, 510 bp, Homo sapiens
  misc_feature: HIJSMM301AE167.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctcgccccctcggtcactctgtt

SEQ ID NO: 552866 - DNA, 507 bp, Homo sapiens
  misc_feature: HIJSMM301AH1FX.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccgggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 552867 - DNA, 497 bp, Homo sapiens
  misc_feature: HIJSMM301EE6Q6.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccccg

SEQ ID NO: 552868 - DNA, 516 bp, Homo sapiens
  misc_feature: HIJSMM301BSLU7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctaatctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgacacgtagaaatagagacggaactacgtggcgtggcaccaactctcgtcttctactcttcccgt

SEQ ID NO: 552869 - DNA, 493 bp, Homo sapiens; identical to SEQ ID NO: 544835
  misc_feature: HIJSMM301A8A9O.43.29.C07.1.454.light.4.raw

SEQ ID NO: 552870 - DNA, 495 bp, Homo sapiens; identical to SEQ ID NO: 535007
  misc_feature: HIJSMM301CFDA1.22.5.A05.1.454.light.4.raw

SEQ ID NO: 552871 - DNA, 478 bp, Homo sapiens; identical to SEQ ID NO: 535129
  misc_feature: HIJSMM301EWO1T.11.11.A11.1.454.light.4.raw

SEQ ID NO: 552872 - DNA, 492 bp, Homo sapiens; identical to SEQ ID NO: 540807
  misc_feature: HIJSMM301D9UQU.41.10.A10.1.454.light.4.raw

SEQ ID NO: 552873 - DNA, 481 bp, Homo sapiens
  misc_feature: HIJSMM301APHR8.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaagg

SEQ ID NO: 552874 - DNA, 383 bp, Homo sapiens; identical to SEQ ID NO: 447524
  misc_feature: HIJSMM301DP7XY.41.26.C04.1.454.light.4.raw

SEQ ID NO: 552875 - DNA, 495 bp, Homo sapiens; identical to SEQ ID NO: 547042
  misc_feature: HIJSMM301AHEQS.51.59.F04.1.454.light.4.raw

SEQ ID NO: 552876 - DNA, 498 bp, Homo sapiens
  misc_feature: HIJSMM301AZ0MV.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtccacttcc

SEQ ID NO: 552877 - DNA, 518 bp, Homo sapiens; identical to SEQ ID NO: 542842
  misc_feature: HIJSMM301ATI6C.8.87.H10.1.454.light.4.raw

SEQ ID NO: 552878 - DNA, 492 bp, Homo sapiens
  misc_feature: HIJSMM301D58CN.51.23.C01.1.454.light.4.raw
cgatcgtatacacgaccggtgctcgatttagtacacgtgattagggattggggtggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcacg

SEQ ID NO: 552879 - DNA, 483 bp, Homo sapiens; identical to SEQ ID NO: 535413
  misc_feature: HIJSMM301AHJQK.26.78.H01.1.454.light.4.raw

SEQ ID NO: 552880 - DNA, 494 bp, Homo sapiens
  misc_feature: HIJSMM301EMI65.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttgggccaggggaccaagttggagatcaaacgaactgtgg

SEQ ID NO: 552881 - DNA, 486 bp, Homo sapiens; identical to SEQ ID NO: 537144
  misc_feature: HIJSMM301CMABS.46.35.D02.1.454.light.4.raw

SEQ ID NO: 552882 - DNA, 488 bp, Homo sapiens
  misc_feature: HIJSMM301EIKFW.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggataatcagacgaa

SEQ ID NO: 552883 - DNA, 491 bp, Homo sapiens
  misc_feature: HIJSMM301BIQ7T.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagcagccaccggagaagttgtcctgacacagtctccagccaccctgtccttgtctccagggcaaagagcctccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcaccatctgt

SEQ ID NO: 552884 - DNA, 507 bp, Homo sapiens
  misc_feature: HIJSMM301BZKMC.9.43.D10.1.454.light.4.raw
tgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccgcctcctc

SEQ ID NO: 552885 - DNA, 454 bp, Homo sapiens; identical to SEQ ID NO: 535005
  misc_feature: HIJSMM301DQT72.19.86.H09.1.454.light.4.raw

SEQ ID NO: 552886 - DNA, 460 bp, Homo sapiens; identical to SEQ ID NO: 536053
  misc_feature: HIJSMM301EHPK0.22.28.C06.1.454.light.4.raw

SEQ ID NO: 552887 - DNA, 496 bp, Homo sapiens; identical to SEQ ID NO: 535109
  misc_feature: HIJSMM301CP75I.16.78.H01.1.454.light.4.raw

SEQ ID NO: 552888 - DNA, 509 bp, Homo sapiens
  misc_feature: HIJSMM301ATWIE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacggtacggaagtacaagacgaactgtggctcgacgaccactctgtcttctatcttcccgt

SEQ ID NO: 552889 - DNA, 518 bp, Homo sapiens; identical to SEQ ID NO: 539372
  misc_feature: HIJSMM301A999T.7.86.H09.1.454.light.4.raw

SEQ ID NO: 552890 - DNA, 509 bp, Homo sapiens; identical to SEQ ID NO: 535938
  misc_feature: HIJSMM301ARTPT.11.57.F02.1.454.light.4.raw

SEQ ID NO: 552891 - DNA, 503 bp, Homo sapiens
  misc_feature: HIJSMM301AWGWQ.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaacatgggatgacaatctgagcggttgggtgttcggcggagggaccaaactgaccgtcctaggtcagcccaa

SEQ ID NO: 552892 - DNA, 383 bp, Homo sapiens
  misc_feature: HIJSMM301CL405.48.53.E09.1.454.light.4.raw
agtatacatacacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 552893 - DNA, 498 bp, Homo sapiens; identical to SEQ ID NO: 535295
  misc_feature: HIJSMM301B88GU.15.25.C03.1.454.light.4.raw

SEQ ID NO: 552894 - DNA, 484 bp, Homo sapiens; identical to SEQ ID NO: 537878
  misc_feature: HIJSMM301D5ZYK.17.34.D01.1.454.light.4.raw

SEQ ID NO: 552895 - DNA, 494 bp, Homo sapiens; identical to SEQ ID NO: 534992
  misc_feature: HIJSMM301D3GQI.9.1.A01.1.454.light.4.raw

SEQ ID NO: 552896 - DNA, 504 bp, Homo sapiens
  misc_feature: HIJSMM301APG3K.48.78.H01.1.454.light.4.raw
agtatacatacacgaccggtgctcgatttagtgtgagtagtttgggtttggggggggtcgacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaacggctgccccctcc

SEQ ID NO: 552897 - DNA, 510 bp, Homo sapiens
  misc_feature: HIJSMM301AGI27.43.23.C01.1.454.light.4.raw
tgtgagtagtcacgaccggtgctcgatttagtacacgtgatttgggattgggaacctatgaacattctgtaggggccactgtcttctccacggtgctcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagccccg

SEQ ID NO: 552898 - DNA, 496 bp, Homo sapiens; identical to SEQ ID NO: 537513
  misc_feature: HIJSMM301EW5ZH.12.87.H10.1.454.light.4.raw

SEQ ID NO: 552899 - DNA, 495 bp, Homo sapiens; identical to SEQ ID NO: 537716
  misc_feature: HIJSMM301BBGP3.22.14.B03.1.454.light.4.raw

SEQ ID NO: 552900 - DNA, 522 bp, Homo sapiens
  misc_feature: HIJSMM301DHYD2.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccct

SEQ ID NO: 552901 - DNA, 498 bp, Homo sapiens
  misc_feature: HIJSMM301EYYJZ.19.83.H06.1.454.light.4.raw
  modified_base (484)..(484): a, c, t, g, unknown or other
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatacaacagagtggaggctgaggatgttggggtttattactgcatgcaagctctacaaactccctcaacgttcggtggagggaccaaggtggagatcaaacgaactgtggctgcaccancttttttgcttcta

SEQ ID NO: 552902 - DNA, 490 bp, Homo sapiens
  misc_feature: HIJSMM301CCHBV.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggacccaagctggagatcacaggaactgtggctgcaccatt

SEQ ID NO: 552903 - DNA, 485 bp, Homo sapiens
  misc_feature: HIJSMM301CHU9D.5.40.D07.1.454.light.4.raw
  modified_base (202)..(202): a, c, t, g, unknown or other
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagngccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccat

SEQ ID NO: 552904 - DNA, 511 bp, Homo sapiens; identical to SEQ ID NO: 537464
  misc_feature: HIJSMM301C8YUX.7.34.D01.1.454.light.4.raw

SEQ ID NO: 552905 - DNA, 513 bp, Homo sapiens; identical to SEQ ID NO: 543716
  misc_feature: HIJSMM301CJSX2.15.76.G10.1.454.light.4.raw
  modified_base (499)..(499): a, c, t, g, unknown or other

SEQ ID NO: 552906 - DNA, 499 bp, Homo sapiens
  misc_feature: HIJSMM301DITHN.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtcctgagcgattcagtggcagcgggtctgggacagatttcactttcaccatcagcagcctgcaggctgaagatgtggcagtttattactgtcagcaatattatagtactccctacacttttggccaggggaccaagctggagatcaaacgaactgtggctgcacca

SEQ ID NO: 552907 - DNA, 502 bp, Homo sapiens
  misc_feature: HIJSMM301ALUMB.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccaaggtggagttcaaacgaactgtggctgcaccatctgtcttcatcttcccgcc

SEQ ID NO: 552908 - DNA, 496 bp, Homo sapiens
  misc_feature: HIJSMM301A2OKR.19.10.A10.1.454.light.4.raw
tactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgca

SEQ ID NO: 552909 - DNA, 494 bp, Homo sapiens; identical to SEQ ID NO: 534994
  misc_feature: HIJSMM301A2GYT.27.78.H01.1.454.light.4.raw

SEQ ID NO: 552910 - DNA, 416 bp, Homo sapiens; identical to SEQ ID NO: 536892
  misc_feature: HIJSMM301C6R84.16.46.E02.1.454.light.4.raw

SEQ ID NO: 552911 - DNA, 502 bp, Homo sapiens; identical to SEQ ID NO: 541971
  misc_feature: HIJSMM301BX960.4.39.D06.1.454.light.4.raw

SEQ ID NO: 552912 - DNA, 512 bp, Homo sapiens; identical to SEQ ID NO: 550704
  misc_feature: HIJSMM301ER95W.15.76.G10.1.454.light.4.raw

SEQ ID NO: 552913 - DNA, 489 bp, Homo sapiens; identical to SEQ ID NO: 535139
  misc_feature: HIJSMM301B4MQS.14.55.E11.1.454.light.4.raw

SEQ ID NO: 552914 - DNA, 496 bp, Homo sapiens; identical to SEQ ID NO: 540261
  misc_feature: HIJSMM301BIU8N.3.78.H01.1.454.light.4.raw

SEQ ID NO: 552915 - DNA, 495 bp, Homo sapiens; identical to SEQ ID NO: 535486
  misc_feature: HIJSMM301C9JDH.26.72.G06.1.454.light.4.raw

SEQ ID NO: 552916 - DNA, 503 bp, Homo sapiens
  misc_feature: HIJSMM301DREGV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactggacatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactagtggctgcaccatctgtcttcatcttccccg

SEQ ID NO: 552917 - DNA, 491 bp, Homo sapiens
  misc_feature: HIJSMM301DZSAF.41.59.F04.1.454.light.4.raw
tctatactatcacgaccggtgctcgatttagtacacacacttagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttccctcaaacattcggccctgggaccagagtggatttgagcgaactgtggctgcaccatctgtt

SEQ ID NO: 552918 - DNA, 521 bp, Homo sapiens; identical to SEQ ID NO: 539470
  misc_feature: HIJSMM301C751V.27.23.C01.1.454.light.4.raw

SEQ ID NO: 552919 - DNA, 484 bp, Homo sapiens
  misc_feature: HIJSMM301D2VV8.49.27.C05.1.454.light.4.raw
agtcgagagacacgaccggtgctcgatttagacgcgatcgaagggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaaatatcacactgctccgctcactttcggcggagggaccagggtggagatcaaacgaa

SEQ ID NO: 552920 - DNA, 501 bp, Homo sapiens
  misc_feature: HIJSMM301DLCLU.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaatcaaacgaactgtggctgcaccatctgtcttcta

SEQ ID NO: 552921 - DNA, 503 bp, Homo sapiens
  misc_feature: HIJSMM301DNA61.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccactctcgttcttctacttcctccccg

SEQ ID NO: 552922 - DNA, 454 bp, Homo sapiens; identical to SEQ ID NO: 535005
  misc_feature: HIJSMM301DELQC.19.86.H09.1.454.light.4.raw

SEQ ID NO: 552923 - DNA, 493 bp, Homo sapiens
  misc_feature: HIJSMM301EISDF.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 552924 - DNA, 460 bp, Homo sapiens; identical to SEQ ID NO: 539553
  misc_feature: HIJSMM301EF69X.11.86.H09.1.454.light.4.raw

SEQ ID NO: 552925 - DNA, 487 bp, Homo sapiens
  misc_feature: HIJSMM301AJW6O.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagcgtggagatcaaacgaactgtggctgcaccat

SEQ ID NO: 552926 - DNA, 484 bp, Homo sapiens; identical to SEQ ID NO: 535400
  misc_feature: HIJSMM301D1JTD.46.26.C04.1.454.light.4.raw

SEQ ID NO: 552927 - DNA, 514 bp, Homo sapiens; identical to SEQ ID NO: 546238
  misc_feature: HIJSMM301EQR9G.47.85.H08.1.454.light.4.raw

SEQ ID NO: 552928 - DNA, 441 bp, Homo sapiens; identical to SEQ ID NO: 535074
  misc_feature: HIJSMM301AJCXW.11.3.A03.1.454.light.4.raw

SEQ ID NO: 552929 - DNA, 499 bp, Homo sapiens
  misc_feature: HIJSMM301AG10Q.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggtccaagggaccaaggtggaaagtcaaacgaactagtggctgcaccatctgtcttcatt

SEQ ID NO: 552930 - DNA, 482 bp, Homo sapiens
  misc_feature: HIJSMM301EXK9L.40.59.F04.1.454.light.4.raw
tctagcgactcacgaccggtgctcgatttagtacacacacttagggattggggggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggccg

SEQ ID NO: 552931 - DNA, 494 bp, Homo sapiens; identical to SEQ ID NO: 534992
  misc_feature: HIJSMM301EVEC8.9.1.A01.1.454.light.4.raw

SEQ ID NO: 552932 - DNA, 510 bp, Homo sapiens
  misc_feature: HIJSMM301EXFYE.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctcccctcactttcggcgggggaccgaaggtggagctcaaacgaactgtggctgcaccatctgtcttcatcttcccg

SEQ ID NO: 552933 - DNA, 508 bp, Homo sapiens
  misc_feature: HIJSMM301D799X.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctggaggacgaggctgattattactgcagctcatatacaagcaccagcactctctatgtcttcggaactgggaccaaggtcaccgtcctaggtcagcccaaggcccaaccccta

SEQ ID NO: 552934 - DNA, 500 bp, Homo sapiens
  misc_feature: HIJSMM301C6ER3.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagagtcaaacgaactagtggctg

SEQ ID NO: 552935 - DNA, 494 bp, Homo sapiens; identical to SEQ ID NO: 534994
  misc_feature: HIJSMM301CQGO3.27.78.H01.1.454.light.4.raw

SEQ ID NO: 552936 - DNA, 489 bp, Homo sapiens; identical to SEQ ID NO: 535139
  misc_feature: HIJSMM301EE403.14.55.E11.1.454.light.4.raw

SEQ ID NO: 552937 - DNA, 505 bp, Homo sapiens
  misc_feature: HIJSMM301EMTTG.40.34.D01.1.454.light.4.raw
tctagcgactcacgaccggtgctcgatttagatcgtctgtgttgggtttgggggtacgctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagctctctggggtccctgatcggttctctggctccatcgacagctcctccaattctgcctccctcaccatctctggactgaagactgaggacaggctgaattattacctggtcagagttatgatgacaccaattactgggtgttcggcggagggaccaagctgaccgtcctaggtcagcccaaggctgccccctggt

SEQ ID NO: 552938 - DNA, 444 bp, Homo sapiens
  misc_feature: HIJSMM301CH1KX.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaattggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 552939 - DNA, 503 bp, Homo sapiens
  misc_feature: HIJSMM301A12AO.15.3.A03.1.454.light.4.raw
  modified_base (414)..(414): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattacngtcagcaatatgaaagtattccttttaacttcgggcccctgggtaccgaaaagtagggataatccaaacggaaactgtggctgcaccat

SEQ ID NO: 552940 - DNA, 512 bp, Homo sapiens
  misc_feature: HIJSMM301BPIUH.17.33.C11.1.454.light.4.raw
  modified_base (495)..(495): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtacnctctgtcccaccctcct

SEQ ID NO: 552941 - DNA, 485 bp, Homo sapiens; identical to SEQ ID NO: 535822
  misc_feature: HIJSMM301BBZTA.14.53.E09.1.454.light.4.raw

SEQ ID NO: 552942 - DNA, 443 bp, Homo sapiens
  misc_feature: HIJSMM301DN130.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 552943 - DNA, 490 bp, Homo sapiens
  misc_feature: HIJSMM301DIHM0.49.80.H03.1.454.light.4.raw
agtcgagagacacgaccggtgctcgatttagctgtgcgtcgaagggaaaggggacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtcctaggtcagcccaagg

SEQ ID NO: 552944 - DNA, 503 bp, Homo sapiens
  misc_feature: HIJSMM301CX3XC.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgacgtcctgggtcagcccaaggctgcccctcggtcactctgttcccaccctcctctacgtcgtat

SEQ ID NO: 552945 - DNA, 503 bp, Homo sapiens
  misc_feature: HIJSMM301BJ2AQ.17.61.F06.1.454.light.4.raw
cgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtcctaggtcagcccaa

SEQ ID NO: 552946 - DNA, 503 bp, Homo sapiens; identical to SEQ ID NO: 539578
  misc_feature: HIJSMM301ENA2B.48.8.A08.1.454.light.4.raw

SEQ ID NO: 552947 - DNA, 484 bp, Homo sapiens
  misc_feature: HIJSMM301BTA22.40.69.G03.1.454.light.4.raw
tctagcgactcacgaccggtgctcgatttagtcgctgcgtaaaggagaaaggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcacc

SEQ ID NO: 552948 - DNA, 484 bp, Homo sapiens; identical to SEQ ID NO: 535400
  misc_feature: HIJSMM301BKCF6.46.26.C04.1.454.light.4.raw

SEQ ID NO: 552949 - DNA, 497 bp, Homo sapiens
  misc_feature: HIJSMM301BDZUS.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggagggaccaagctgaccgtcctaggtcagcccaaggctgccccccg

SEQ ID NO: 552950 - DNA, 496 bp, Homo sapiens
  misc_feature: HIJSMM301C4X8Q.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctggtcactctcg

SEQ ID NO: 552951 - DNA, 497 bp, Homo sapiens; identical to SEQ ID NO: 535740
  misc_feature: HIJSMM301BILMP.3.71.G05.1.454.light.4.raw

SEQ ID NO: 552952 - DNA, 485 bp, Homo sapiens; identical to SEQ ID NO: 535501
  misc_feature: HIJSMM301CDRHK.3.10.A10.1.454.light.4.raw

SEQ ID NO: 552953 - DNA, 494 bp, Homo sapiens; identical to SEQ ID NO: 535629
  misc_feature: HIJSMM301DNJTW.4.27.C05.1.454.light.4.raw

SEQ ID NO: 552954 - DNA, 491 bp, Homo sapiens; identical to SEQ ID NO: 536693
  misc_feature: HIJSMM301AS6WI.19.83.H06.1.454.light.4.raw

SEQ ID NO: 552955 - DNA, 494 bp, Homo sapiens; identical to SEQ ID NO: 534994
  misc_feature: HIJSMM301D2WC4.27.78.H01.1.454.light.4.raw

SEQ ID NO: 552956 - DNA, 518 bp, Homo sapiens; identical to SEQ ID NO: 539372
  misc_feature: HIJSMM301B3C3R.7.86.H09.1.454.light.4.raw

SEQ ID NO: 552957 - DNA, 492 bp, Homo sapiens
  misc_feature: HIJSMM301DD9N6.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgatgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccacgggaccacagtggatatcaggcgaactgtggctgcaccatctgtt

SEQ ID NO: 552958 - DNA, 477 bp, Homo sapiens; identical to SEQ ID NO: 535266
  misc_feature: HIJSMM301DU3R1.4.34.D01.1.454.light.4.raw

SEQ ID NO: 552959 - DNA, 485 bp, Homo sapiens; identical to SEQ ID NO: 543441
  misc_feature: HIJSMM301BI0N2.26.55.E11.1.454.light.4.raw

SEQ ID NO: 552960 - DNA, 485 bp, Homo sapiens
  misc_feature: HIJSMM301EVJPX.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaaagattatgcaacttactattgtcagagttctaattctttcccgcgcacgtttggccaggggaccaaggtagagatcaaacgaactgtggctgcaccat

SEQ ID NO: 552961 - DNA, 495 bp, Homo sapiens
  misc_feature: HIJSMM301ASIEY.26.77.G11.1.454.light.4.raw
agactatactcacgaccggtgctcgatttagctagtcactcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttcccg

SEQ ID NO: 552962 - DNA, 483 bp, Homo sapiens; identical to SEQ ID NO: 542200
  misc_feature: HIJSMM301EI7KH.7.75.G09.1.454.light.4.raw

SEQ ID NO: 552963 - DNA, 504 bp, Homo sapiens; identical to SEQ ID NO: 538521
  misc_feature: HIJSMM301EX6QS.9.12.B01.1.454.light.4.raw

SEQ ID NO: 552964 - DNA, 474 bp, Homo sapiens
  misc_feature: HIJSMM301B3ZO4.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtaga

SEQ ID NO: 552965 - DNA, 491 bp, Homo sapiens; identical to SEQ ID NO: 535176
  misc_feature: HIJSMM301ESSRV.13.39.D06.1.454.light.4.raw

SEQ ID NO: 552966 - DNA, 513 bp, Homo sapiens
  misc_feature: HIJSMM301DVC0C.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctctcgctacgtaga

SEQ ID NO: 552967 - DNA, 454 bp, Homo sapiens; identical to SEQ ID NO: 534964
  misc_feature: HIJSMM301AJ4ZE.19.86.H09.1.454.light.4.raw

SEQ ID NO: 552968 - DNA, 491 bp, Homo sapiens; identical to SEQ ID NO: 535194
  misc_feature: HIJSMM301B086Z.26.78.H01.1.454.light.4.raw

SEQ ID NO: 552969 - DNA, 473 bp, Homo sapiens; identical to SEQ ID NO: 535262
  misc_feature: HIJSMM301CREZN.8.67.G01.1.454.light.4.raw

SEQ ID NO: 552970 - DNA, 336 bp, Homo sapiens
  misc_feature: HIJSMM301AP0J3.15.26.C04.1.454.light.4.raw
tctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtaga

SEQ ID NO: 552971 - DNA, 486 bp, Homo sapiens
  misc_feature: HIJSMM301EYUQ3.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtgacactgggtctgagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 552972 - DNA, 463 bp, Homo sapiens; identical to SEQ ID NO: 535062
  misc_feature: HIJSMM301AJ9GN.11.73.G07.1.454.light.4.raw

SEQ ID NO: 552973 - DNA, 463 bp, Homo sapiens; identical to SEQ ID NO: 540740
  misc_feature: HIJSMM301ASI21.52.8.A08.1.454.light.4.raw

SEQ ID NO: 552974 - DNA, 513 bp, Homo sapiens
  misc_feature: HIJSMM301ANKXS.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctgttcccaccct

SEQ ID NO: 552975 - DNA, 484 bp, Homo sapiens; identical to SEQ ID NO: 539003
  misc_feature: HIJSMM301DYBV0.10.1.A01.1.454.light.4.raw

SEQ ID NO: 552976 - DNA, 497 bp, Homo sapiens; identical to SEQ ID NO: 538030
  misc_feature: HIJSMM301BQKI2.40.23.C01.1.454.light.4.raw

SEQ ID NO: 552977 - DNA, 508 bp, Homo sapiens; identical to SEQ ID NO: 536388
  misc_feature: HIJSMM301BUPYP.11.57.F02.1.454.light.4.raw

SEQ ID NO: 552978 - DNA, 434 bp, Homo sapiens; identical to SEQ ID NO: 535153
  misc_feature: HIJSMM301DD471.18.5.A05.1.454.light.4.raw

SEQ ID NO: 552979 - DNA, 508 bp, Homo sapiens; identical to SEQ ID NO: 535835
  misc_feature: HIJSMM301EPXFO.8.34.D01.1.454.light.4.raw

SEQ ID NO: 552980 - DNA, 447 bp, Homo sapiens
  misc_feature: HIJSMM301AI9MP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcatcgtcctaagtcagcccaaggccaacccctctgtcactctgttcccgccctcctccatactcgta

SEQ ID NO: 552981 - DNA, 485 bp, Homo sapiens; identical to SEQ ID NO: 536263
  misc_feature: HIJSMM301DX0B6.47.78.H01.1.454.light.4.raw

SEQ ID NO: 552982 - DNA, 480 bp, Homo sapiens
  misc_feature: HIJSMM301DNQ7G.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctgtgttcggcggagggaccaggctgaccgtcctaggtcagcccaaggctgcccccc

SEQ ID NO: 552983 - DNA, 444 bp, Homo sapiens; identical to SEQ ID NO: 535192
  misc_feature: HIJSMM301EXBSM.5.9.A09.1.454.light.4.raw

SEQ ID NO: 552984 - DNA, 491 bp, Homo sapiens; identical to SEQ ID NO: 542310
  misc_feature: HIJSMM301AHEZV.22.65.F10.1.454.light.4.raw

SEQ ID NO: 552985 - DNA, 502 bp, Homo sapiens
  misc_feature: HIJSMM301EKER7.10.86.H09.1.454.light.4.raw
catagtagtgcacgaccggtgctcgatttagtgctatagactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 552986 - DNA, 474 bp, Homo sapiens
  misc_feature: HIJSMM301DYY0M.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatacaaacgaa

SEQ ID NO: 552987 - DNA, 495 bp, Homo sapiens; identical to SEQ ID NO: 536055
  misc_feature: HIJSMM301BF4B8.47.38.D05.1.454.light.4.raw

SEQ ID NO: 552988 - DNA, 494 bp, Homo sapiens; identical to SEQ ID NO: 534994
  misc_feature: HIJSMM301DV8IJ.27.78.H01.1.454.light.4.raw

SEQ ID NO: 552989 - DNA, 454 bp, Homo sapiens; identical to SEQ ID NO: 534964
  misc_feature: HIJSMM301CSHTX.19.86.H09.1.454.light.4.raw

SEQ ID NO: 552990 - DNA, 447 bp, Homo sapiens; identical to SEQ ID NO: 535020
  misc_feature: HIJSMM301BD7QJ.18.9.A09.1.454.light.4.raw

SEQ ID NO: 552991 - DNA, 506 bp, Homo sapiens; identical to SEQ ID NO: 545735
  misc_feature: HIJSMM301BOIPT.8.71.G05.1.454.light.4.raw

SEQ ID NO: 552992 - DNA, 483 bp, Homo sapiens
  misc_feature: HIJSMM301C32NG.13.6.A06.1.454.light.4.raw
  modified_base (442)..(442): a, c, t, g, unknown or other
tcacgtactacacgaccggtgctcgatttagatctactgacagggggggtctcgaggagggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactnttcggcggagggaccaagctgaccgtcctaggtcagcccaa

SEQ ID NO: 552993 - DNA, 506 bp, Homo sapiens; identical to SEQ ID NO: 546197
  misc_feature: HIJSMM301AZDQU.9.12.B01.1.454.light.4.raw

SEQ ID NO: 552994 - DNA, 494 bp, Homo sapiens
  misc_feature: HIJSMM301B0KFD.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctctcctcagggacaacagtcacgttgatcatcagtggagtccggcagaggacgaggctgactattactgtcaatcaacagacagtagtggtacttatgtgcagttcggcggagggaccaagctgaccgtctaggtcagcccaaggctgccccctggt

SEQ ID NO: 552995 - DNA, 495 bp, Homo sapiens; identical to SEQ ID NO: 535007
  misc_feature: HIJSMM301BOHNG.22.5.A05.1.454.light.4.raw

SEQ ID NO: 552996 - DNA, 443 bp, Homo sapiens
  misc_feature: HIJSMM301B5US1.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggacgaggctgattattactgcagctcatatacaagcaccagcactctctatgtcttcggaactgggaccaaggtcaccgtcctaggtcagcccaaggccaacccactgtcactctgttcccaccctcctccatactcgta

SEQ ID NO: 552997 - DNA, 489 bp, Homo sapiens; identical to SEQ ID NO: 535139
  misc_feature: HIJSMM301DQMNO.14.55.E11.1.454.light.4.raw

SEQ ID NO: 552998 - DNA, 497 bp, Homo sapiens; identical to SEQ ID NO: 535664
  misc_feature: HIJSMM301DRN1B.22.14.B03.1.454.light.4.raw

SEQ ID NO: 552999 - DNA, 503 bp, Homo sapiens
  misc_feature: HIJSMM301DO5LP.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgagactggccgttcactttcggcggagggaccaaggtggacctcaaacgaactgtggctgcaccatctgtcttcatcttccgcc

SEQ ID NO: 553000 - DNA, 479 bp, Homo sapiens
  misc_feature: HIJSMM301CYEN0.52.40.D07.1.454.light.4.raw
cgcagtacgacacgaccggtgctcgatttagtgatagagcgtaacaacagaggggcagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccaggggaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcaccta

SEQ ID NO: 553001 - DNA, 484 bp, Homo sapiens; identical to SEQ ID NO: 535400
  misc_feature: HIJSMM301CYWVR.46.26.C04.1.454.light.4.raw

SEQ ID NO: 553002 - DNA, 481 bp, Homo sapiens
  misc_feature: HIJSMM301EAP8H.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 553003 - DNA, 480 bp, Homo sapiens
  misc_feature: HIJSMM301AO6V3.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccagggaccaggctggagatcagacgaactgt

SEQ ID NO: 553004 - DNA, 521 bp, Homo sapiens; identical to SEQ ID NO: 539470
  misc_feature: HIJSMM301D84SW.27.23.C01.1.454.light.4.raw

SEQ ID NO: 553005 - DNA, 487 bp, Homo sapiens
  misc_feature: HIJSMM301ALLT1.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcggtgggacagcagcactgcccgttatgtcttcggaactggaccgaaggtcacgtccttgagtcagcccaaggcc

SEQ ID NO: 553006 - DNA, 480 bp, Homo sapiens; identical to SEQ ID NO: 545225
  misc_feature: HIJSMM301B9MOL.43.12.B01.1.454.light.4.raw

SEQ ID NO: 553007 - DNA, 487 bp, Homo sapiens; identical to SEQ ID NO: 536206
  misc_feature: HIJSMM301EFXO5.47.38.D05.1.454.light.4.raw

SEQ ID NO: 553008 - DNA, 505 bp, Homo sapiens; identical to SEQ ID NO: 536254
  misc_feature: HIJSMM301BI8UN.7.71.G05.1.454.light.4.raw

SEQ ID NO: 553009 - DNA, 383 bp, Homo sapiens
  misc_feature: HIJSMM301BAI2I.41.25.C03.1.454.light.4.raw
tctatactatcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 553010 - DNA, 484 bp, Homo sapiens
  misc_feature: HIJSMM301EN21G.4.8.A08.1.454.light.4.raw
agcactgtagcacgaccggtgctcgatttagcatactctacaggggctgggcctcaggaagcagcatcggaggtgcctcagccatggcatggatccctctcttcctcggcgtccttgcttactgcacaggatccgtgccctcctatgaactgactcagccaccgtcagtgtccgtgtccccaggacagacagccagcattagttgctctggagatagattggagaataaatttgttacctggtatcagcagaagccaggccagtcccctgtgctggtcatctatcaggataaggagcggccctcagggatccctgagcgaatctctggctccaactctgggaacacagccactctgaccatcagcgggacccaggctatggatgagggtgactattactgtcaggcgtgggacagcccttatgtggtattcggcggagggaccaagctgaccgtcctaggtcagcccaaggctgccccctcggt

SEQ ID NO: 553011 - DNA, 487 bp, Homo sapiens; identical to SEQ ID NO: 536025
  misc_feature: HIJSMM301ED9NY.17.34.D01.1.454.light.4.raw

SEQ ID NO: 553012 - DNA, 494 bp, Homo sapiens; identical to SEQ ID NO: 539922
  misc_feature: HIJSMM301EK9AW.27.78.H01.1.454.light.4.raw

SEQ ID NO: 553013 - DNA, 481 bp, Homo sapiens
  misc_feature: HIJSMM301AK4NC.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctg

SEQ ID NO: 553014 - DNA, 519 bp, Homo sapiens
  misc_feature: HIJSMM301CT7XT.41.9.A09.1.454.light.4.raw
tctatactatcacgaccggtgctcgatttagcgagacgcgcagggggtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcat

SEQ ID NO: 553015 - DNA, 378 bp, Homo sapiens
  misc_feature: HIJSMM301CUIB7.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 553016 - DNA, 492 bp, Homo sapiens; identical to SEQ ID NO: 550823
  misc_feature: HIJSMM301BRZIX.49.20.B09.1.454.light.4.raw

SEQ ID NO: 553017 - DNA, 460 bp, Homo sapiens; identical to SEQ ID NO: 536053
  misc_feature: HIJSMM301COA6B.22.28.C06.1.454.light.4.raw

SEQ ID NO: 553018 - DNA, 498 bp, Homo sapiens
  misc_feature: HIJSMM301C3YGY.3.37.D04.1.454.light.4.raw
agacgcactccacgaccggtgctcgatttagtagcatactgttgggtttgggggatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttatactgcgtgcaagttcgacaaaccccattcactttcggccctgggaccaaagtggacatcaaacgaactgtggctgcaccatctgt

SEQ ID NO: 553019 - DNA, 481 bp, Homo sapiens
  misc_feature: HIJSMM301A1CIU.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgccaacagtatgatgattacccgtacacttttggccaggggaccaagctggagatcaatcgaactgtggctgcacc

SEQ ID NO: 553020 - DNA, 508 bp, Homo sapiens
  misc_feature: HIJSMM301B8142.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgccat

SEQ ID NO: 553021 - DNA, 491 bp, Homo sapiens; identical to SEQ ID NO: 535294
  misc_feature: HIJSMM301CETXJ.16.68.G02.1.454.light.4.raw

SEQ ID NO: 553022 - DNA, 488 bp, Homo sapiens; identical to SEQ ID NO: 545695
  misc_feature: HIJSMM301A0KOU.46.26.C04.1.454.light.4.raw

SEQ ID NO: 553023 - DNA, 484 bp, Homo sapiens; identical to SEQ ID NO: 540581
  misc_feature: HIJSMM301CRWPY.3.88.H11.1.454.light.4.raw

SEQ ID NO: 553024 - DNA, 484 bp, Homo sapiens; identical to SEQ ID NO: 535400
  misc_feature: HIJSMM301D4Y0V.46.26.C04.1.454.light.4.raw

SEQ ID NO: 553025 - DNA, 492 bp, Homo sapiens
  misc_feature: HIJSMM301ALSNZ.41.2.A02.1.454.light.4.raw
tctatactatcacgaccggtgctcgatttagactcatctacagggggtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcacagtctcatggtctcccccttagtttcggcggagggaccaaggttgagatcaaacgaactgtggctgcaccatctgtcttcatcttccccg

SEQ ID NO: 553026 - DNA, 489 bp, Homo sapiens
  misc_feature: HIJSMM301CZUX9.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcacctttcactttcggcggagggaccaaggtggagaacaaacgaactgtggctgcaccat

SEQ ID NO: 553027 - DNA, 505 bp, Homo sapiens; identical to SEQ ID NO: 537876
  misc_feature: HIJSMM301CS8Q0.5.68.G02.1.454.light.4.raw

SEQ ID NO: 553028 - DNA, 487 bp, Homo sapiens; identical to SEQ ID NO: 535508
  misc_feature: HIJSMM301BML3T.13.87.H10.1.454.light.4.raw

SEQ ID NO: 553029 - DNA, 512 bp, Homo sapiens; identical to SEQ ID NO: 537564
  misc_feature: HIJSMM301BZA0W.17.33.C11.1.454.light.4.raw

SEQ ID NO: 553030 - DNA, 447 bp, Homo sapiens; identical to SEQ ID NO: 535020
  misc_feature: HIJSMM301ANA39.18.9.A09.1.454.light.4.raw

SEQ ID NO: 553031 - DNA, 484 bp, Homo sapiens; identical to SEQ ID NO: 535240
  misc_feature: HIJSMM301A3T3B.47.60.F05.1.454.light.4.raw

SEQ ID NO: 553032 - DNA, 485 bp, Homo sapiens; identical to SEQ ID NO: 535880
  misc_feature: HIJSMM301EBE5G.7.75.G09.1.454.light.4.raw

SEQ ID NO: 553033 - DNA, 504 bp, Homo sapiens
  misc_feature: HIJSMM301BWMQZ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtattcatcttccgccat

SEQ ID NO: 553034 - DNA, 493 bp, Homo sapiens
  misc_feature: HIJSMM301CEV52.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacgatcaagcgaactgtggcgtgcaccatctgtt

SEQ ID NO: 553035 - DNA, 516 bp, Homo sapiens
  misc_feature: HIJSMM301ALPAJ.12.85.H08.1.454.light.4.raw
atacgacgtacacgaccggtgctcgatttagtatcactcagtcgcggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtctaagtcagcccaaggctcgccccctcggtcactctcgttcccg

SEQ ID NO: 553036 - DNA, 494 bp, Homo sapiens; identical to SEQ ID NO: 534992
  misc_feature: HIJSMM301ATD73.9.1.A01.1.454.light.4.raw

SEQ ID NO: 553037 - DNA, 504 bp, Homo sapiens; identical to SEQ ID NO: 535561
  misc_feature: HIJSMM301DUFVZ.4.57.F02.1.454.light.4.raw

SEQ ID NO: 553038 - DNA, 496 bp, Homo sapiens
  misc_feature: HIJSMM301C5ZEO.53.81.H04.1.454.light.4.raw
cgcgtatacacacgaccggtgctcgatttagtagtgtagattcgcggggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaagg

SEQ ID NO: 553039 - DNA, 511 bp, Homo sapiens
  misc_feature: HIJSMM301AYNOA.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccagactgcccctccgtcgactctcgttccgtccct

SEQ ID NO: 553040 - DNA, 499 bp, Homo sapiens
  misc_feature: HIJSMM301DQFT0.19.71.G05.1.454.light.4.raw
tactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccagtcaactgcaagtccagccacaatctttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaagtgggataatc

SEQ ID NO: 553041 - DNA, 495 bp, Homo sapiens; identical to SEQ ID NO: 539836
  misc_feature: HIJSMM301DCZ8D.9.1.A01.1.454.light.4.raw

SEQ ID NO: 553042 - DNA, 462 bp, Homo sapiens
  misc_feature: HIJSMM301DF1K4.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 553043 - DNA, 501 bp, Homo sapiens; identical to SEQ ID NO: 536142
  misc_feature: HIJSMM301BQ3O2.15.1.A01.1.454.light.4.raw

SEQ ID NO: 553044 - DNA, 505 bp, Homo sapiens; identical to SEQ ID NO: 546412
  misc_feature: HIJSMM301BIHD0.22.21.B10.1.454.light.4.raw

SEQ ID NO: 553045 - DNA, 503 bp, Homo sapiens
  misc_feature: HIJSMM301AVV74.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaacccactgtc

SEQ ID NO: 553046 - DNA, 478 bp, Homo sapiens; identical to SEQ ID NO: 544596
  misc_feature: HIJSMM301EGRZA.21.25.C03.1.454.light.4.raw

SEQ ID NO: 553047 - DNA, 506 bp, Homo sapiens
  misc_feature: HIJSMM301DE2H9.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccaccctt

SEQ ID NO: 553048 - DNA, 444 bp, Homo sapiens; identical to SEQ ID NO: 535027
  misc_feature: HIJSMM301CWLQC.8.73.G07.1.454.light.4.raw

SEQ ID NO: 553049 - DNA, 447 bp, Homo sapiens
  misc_feature: HIJSMM301A4KT5.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcggcggagggaccaggctgaccgtcgtgggtcagcccaaggctgccccctcggtcactctgttcccgccctcctccatactcgta

SEQ ID NO: 553050 - DNA, 496 bp, Homo sapiens; identical to SEQ ID NO: 535109
  misc_feature: HIJSMM301AQ0JJ.16.78.H01.1.454.light.4.raw

SEQ ID NO: 553051 - DNA, 497 bp, Homo sapiens
  misc_feature: HIJSMM301EP68F.48.23.C01.1.454.light.4.raw
agtatacatacacgaccggtgctcgatttagtacacgtgattagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatactc

SEQ ID NO: 553052 - DNA, 444 bp, Homo sapiens; identical to SEQ ID NO: 534993
  misc_feature: HIJSMM301C5GB2.5.9.A09.1.454.light.4.raw

SEQ ID NO: 553053 - DNA, 496 bp, Homo sapiens
  misc_feature: HIJSMM301BM7T0.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtactacttttggccaggggaccaagctagaatacaaacgaactgtggctgcaccatctgtcttcta

SEQ ID NO: 553054 - DNA, 486 bp, Homo sapiens; identical to SEQ ID NO: 538219
  misc_feature: HIJSMM301BD5JK.47.70.G04.1.454.light.4.raw

SEQ ID NO: 553055 - DNA, 499 bp, Homo sapiens; identical to SEQ ID NO: 543887
  misc_feature: HIJSMM301ALRE2.10.65.F10.1.454.light.4.raw

SEQ ID NO: 553056 - DNA, 490 bp, Homo sapiens; identical to SEQ ID NO: 540741
  misc_feature: HIJSMM301CDBYR.14.55.E11.1.454.light.4.raw

SEQ ID NO: 553057 - DNA, 498 bp, Homo sapiens
  misc_feature: HIJSMM301D1OB6.43.34.D01.1.454.light.4.raw
  modified_base (456)..(456): a, c, t, g, unknown or other
tgtgagtagtcacgaccggtgctcgatttagatcgtctgtgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggngttcggcggaggaccaagggtgaccgtcctagggtcagcccc

SEQ ID NO: 553058 - DNA, 488 bp, Homo sapiens; identical to SEQ ID NO: 537504
  misc_feature: HIJSMM301DZ05Y.17.57.F02.1.454.light.4.raw

SEQ ID NO: 553059 - DNA, 502 bp, Homo sapiens; identical to SEQ ID NO: 539341
  misc_feature: HIJSMM301AEX7Y.40.41.D08.1.454.light.4.raw

SEQ ID NO: 553060 - DNA, 497 bp, Homo sapiens
  misc_feature: HIJSMM301DFBJQ.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccgagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 553061 - DNA, 475 bp, Homo sapiens
  misc_feature: HIJSMM301DQ6BZ.4.76.G10.1.454.light.4.raw
agcactgtagcacgaccggtgctcgatttagtcactcatacaggggaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaagggaccaaggtggaaatcaaacgaactgtggctgcacca

SEQ ID NO: 553062 - DNA, 493 bp, Homo sapiens; identical to SEQ ID NO: 536246
  misc_feature: HIJSMM301EQMRS.49.66.F11.1.454.light.4.raw

SEQ ID NO: 553063 - DNA, 500 bp, Homo sapiens; identical to SEQ ID NO: 544792
  misc_feature: HIJSMM301EG0YF.18.11.A11.1.454.light.4.raw

SEQ ID NO: 553064 - DNA, 486 bp, Homo sapiens; identical to SEQ ID NO: 535043
  misc_feature: HIJSMM301BHLSN.46.35.D02.1.454.light.4.raw

SEQ ID NO: 553065 - DNA, 376 bp, Homo sapiens
  misc_feature: HIJSMM301A0Y39.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccagacaacctcctaagttgctcttttactgggcgtcttcccgggagtccggggtccctgaccgattcagtgccagcgggtctgggacagacttcactctcacca

SEQ ID NO: 553066 - DNA, 507 bp, Homo sapiens
  misc_feature: HIJSMM301AQR53.53.49.E05.1.454.light.4.raw
cgcgtatacacacgaccggtgctcgatttagagcgactagcaacacacaaaggggagtctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggaggggaccaaggctgaccgtcctgggtcagcccaaggctgccccctcggtcac

SEQ ID NO: 553067 - DNA, 497 bp, Homo sapiens; identical to SEQ ID NO: 538382
  misc_feature: HIJSMM301DRE2Q.3.33.C11.1.454.light.4.raw

SEQ ID NO: 553068 - DNA, 492 bp, Homo sapiens; identical to SEQ ID NO: 537666
  misc_feature: HIJSMM301BNI06.43.33.C11.1.454.light.4.raw

SEQ ID NO: 553069 - DNA, 487 bp, Homo sapiens
  misc_feature: HIJSMM301AQJ8R.52.59.F04.1.454.light.4.raw
cgcagtacgacacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggtcggagggaccaaggtggagatcagacgaactgtggctgcaccatctgtctt

SEQ ID NO: 553070 - DNA, 512 bp, Homo sapiens
  misc_feature: HIJSMM301CF1OC.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaagtacaagacgaacgtagtggcgtgcaccatcctgtcttctatcttcccgt

SEQ ID NO: 553071 - DNA, 491 bp, Homo sapiens; identical to SEQ ID NO: 538021
  misc_feature: HIJSMM301A2W2T.3.72.G06.1.454.light.4.raw

SEQ ID NO: 553072 - DNA, 454 bp, Homo sapiens; identical to SEQ ID NO: 552344
  misc_feature: HIJSMM301BG4U8.19.86.H09.1.454.light.4.raw

SEQ ID NO: 553073 - DNA, 509 bp, Homo sapiens
  misc_feature: HIJSMM301ASD0D.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 553074 - DNA, 489 bp, Homo sapiens
  misc_feature: HIJSMM301DEVSF.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgtactagacg

SEQ ID NO: 553075 - DNA, 521 bp, Homo sapiens
  misc_feature: HIJSMM301ALGXB.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagtgacgtcctcgtcagccacgcgtcgcccctccggtcgactctcgttcctaccctccctctacg

SEQ ID NO: 553076 - DNA, 501 bp, Homo sapiens; identical to SEQ ID NO: 536818
  misc_feature: HIJSMM301BTTB6.12.82.H05.1.454.light.4.raw

SEQ ID NO: 553077 - DNA, 503 bp, Homo sapiens; identical to SEQ ID NO: 551847
  misc_feature: HIJSMM301CS65Z.27.78.H01.1.454.light.4.raw
  modified_base (495)..(495): a, c, t, g, unknown or other

SEQ ID NO: 553078 - DNA, 488 bp, Homo sapiens
  misc_feature: HIJSMM301DGHP3.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaaatttcactctcaccatcagcagtctgcaacctgaagattttgcaacttactattgtcaacagagttacagtattcctttcactttcggccctggaccgaagtcgatatcaaacgaactgtggctgcaccatctgt

SEQ ID NO: 553079 - DNA, 487 bp, Homo sapiens
  misc_feature: HIJSMM301AQPBK.3.55.E11.1.454.light.4.raw
agacgcactccacgaccggtgctcgatttagcactcgcacgttgggtttgggggaggaactgctcagttaggacctagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgt

SEQ ID NO: 553080 - DNA, 510 bp, Homo sapiens
  misc_feature: HIJSMM301BY2EE.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgccgat

SEQ ID NO: 553081 - DNA, 502 bp, Homo sapiens
  misc_feature: HIJSMM301DWRSS.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcgccaagggaccaaggtggaaatcaaacgaactagtggctgcaccatctgtcttcatcttccccg

SEQ ID NO: 553082 - DNA, 484 bp, Homo sapiens; identical to SEQ ID NO: 537427
  misc_feature: HIJSMM301EWEKZ.26.78.H01.1.454.light.4.raw

SEQ ID NO: 553083 - DNA, 503 bp, Homo sapiens
  misc_feature: HIJSMM301C842Y.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagttttattactgtcagcagcgtagcaactggcctccgatcaccttcggccaagggacacgactggagattaaacgaactgtggctgcaccatctgtcttcattcc

SEQ ID NO: 553084 - DNA, 536 bp, Homo sapiens
  misc_feature: HIJSMM301A1TSP.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggacgggaccaagtgacgtccgtacgtacgtacgaccgaccgacgtcgtccccgtccccgtccggtacctctcgttcccgtacccctcccctccta

SEQ ID NO: 553085 - DNA, 489 bp, Homo sapiens; identical to SEQ ID NO: 535386
  misc_feature: HIJSMM301AJ0TK.12.51.E07.1.454.light.4.raw

SEQ ID NO: 553086 - DNA, 481 bp, Homo sapiens
  misc_feature: HIJSMM301DEY5T.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaactgtggctgcaccta

SEQ ID NO: 553087 - DNA, 512 bp, Homo sapiens
  misc_feature: HIJSMM301CBIFC.43.23.C01.1.454.light.4.raw
tgtgagtagtcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 553088 - DNA, 487 bp, Homo sapiens
  misc_feature: HIJSMM301CMKOX.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgccccaaccttcggccaggggacacgactggagattaaacgaactgtggctgcaccat

SEQ ID NO: 553089 - DNA, 480 bp, Homo sapiens; identical to SEQ ID NO: 535291
  misc_feature: HIJSMM301DAZMT.22.59.F04.1.454.light.4.raw

SEQ ID NO: 553090 - DNA, 454 bp, Homo sapiens; identical to SEQ ID NO: 534964
  misc_feature: HIJSMM301D6BKT.19.86.H09.1.454.light.4.raw

SEQ ID NO: 553091 - DNA, 514 bp, Homo sapiens; identical to SEQ ID NO: 538901
  misc_feature: HIJSMM301AV1NG.51.27.C05.1.454.light.4.raw

SEQ ID NO: 553092 - DNA, 485 bp, Homo sapiens; identical to SEQ ID NO: 536075
  misc_feature: HIJSMM301AOVB0.17.21.B10.1.454.light.4.raw

SEQ ID NO: 553093 - DNA, 498 bp, Homo sapiens
  misc_feature: HIJSMM301CGE7S.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttctactttccggcccgtcggaccggaagtacgtataattcaaacgaactgtggtctgcaccatctgtt

SEQ ID NO: 553094 - DNA, 488 bp, Homo sapiens; identical to SEQ ID NO: 536554
  misc_feature: HIJSMM301DB50H.26.37.D04.1.454.light.4.raw

SEQ ID NO: 553095 - DNA, 491 bp, Homo sapiens; identical to SEQ ID NO: 535294
  misc_feature: HIJSMM301EDPXI.16.68.G02.1.454.light.4.raw

SEQ ID NO: 553096 - DNA, 486 bp, Homo sapiens; identical to SEQ ID NO: 535385
  misc_feature: HIJSMM301BLNUP.19.71.G05.1.454.light.4.raw

SEQ ID NO: 553097 - DNA, 502 bp, Homo sapiens
  misc_feature: HIJSMM301EQJIX.48.79.H02.1.454.light.4.raw
agtatacatacacgaccggtgctcgatttagtgtcacacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaaggaccgaacggtggaaatacaaacgaactagtggcgtgcgaccta

SEQ ID NO: 553098 - DNA, 492 bp, Homo sapiens
  misc_feature: HIJSMM301ATLSV.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcaggtggaggctgaggatgttggggtttgttcctccatgcaaggtacacactggccttttggccaggggaccaacctggagatcaaatgaactgtggctgcaccatctgtctt

SEQ ID NO: 553099 - DNA, 487 bp, Homo sapiens
  misc_feature: HIJSMM301CP9ET.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 553100 - DNA, 499 bp, Homo sapiens; identical to SEQ ID NO: 539754
  misc_feature: HIJSMM301EFQEZ.11.21.B10.1.454.light.4.raw

SEQ ID NO: 553101 - DNA, 502 bp, Homo sapiens
  misc_feature: HIJSMM301CZC96.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggccaagggaccaaggtggaaatcaaacgaactgtggctgcaccatctgtcttcatcttccccg

SEQ ID NO: 553102 - DNA, 502 bp, Homo sapiens; identical to SEQ ID NO: 537363
  misc_feature: HIJSMM301DQ59Z.18.23.C01.1.454.light.4.raw

SEQ ID NO: 553103 - DNA, 461 bp, Homo sapiens; identical to SEQ ID NO: 538478
  misc_feature: HIJSMM301EBO4Z.51.23.C01.1.454.light.4.raw

SEQ ID NO: 553104 - DNA, 479 bp, Homo sapiens
  misc_feature: HIJSMM301C8YSP.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacaactggccgtacacttttggccagggaccaagctggagatcaatcgaa

SEQ ID NO: 553105 - DNA, 486 bp, Homo sapiens; identical to SEQ ID NO: 537127
  misc_feature: HIJSMM301C0LTY.3.77.G11.1.454.light.4.raw

SEQ ID NO: 553106 - DNA, 487 bp, Homo sapiens
  misc_feature: HIJSMM301D5KR7.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtcaagcgaactgtggctgcaccat

SEQ ID NO: 553107 - DNA, 401 bp, Homo sapiens
  misc_feature: HIJSMM301AVQ7H.8.53.E09.1.454.light.4.raw
ctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 553108 - DNA, 481 bp, Homo sapiens
  misc_feature: HIJSMM301CS7DC.4.74.G08.1.454.light.4.raw
  modified_base (285)..(285): a, c, t, g, unknown or other
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatntacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaactagtggctgcacca

SEQ ID NO: 553109 - DNA, 503 bp, Homo sapiens; identical to SEQ ID NO: 547049
  misc_feature: HIJSMM301DEH9R.18.59.F04.1.454.light.4.raw

SEQ ID NO: 553110 - DNA, 480 bp, Homo sapiens
  misc_feature: HIJSMM301CFW42.13.59.F04.1.454.light.4.raw
tcacgtactacacgaccggtgctcgatttagtacacacacttagggattgggggcagaagtctctctcagtcaggacaccagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 553111 - DNA, 520 bp, Homo sapiens; identical to SEQ ID NO: 537173
  misc_feature: HIJSMM301DNSWT.27.23.C01.1.454.light.4.raw

SEQ ID NO: 553112 - DNA, 502 bp, Homo sapiens; identical to SEQ ID NO: 541971
  misc_feature: HIJSMM301AQQQF.4.39.D06.1.454.light.4.raw

SEQ ID NO: 553113 - DNA, 515 bp, Homo sapiens; identical to SEQ ID NO: 539211
  misc_feature: HIJSMM301BT8QN.22.28.C06.1.454.light.4.raw

SEQ ID NO: 553114 - DNA, 484 bp, Homo sapiens; identical to SEQ ID NO: 535400
  misc_feature: HIJSMM301A3QZU.46.26.C04.1.454.light.4.raw

SEQ ID NO: 553115 - DNA, 505 bp, Homo sapiens; identical to SEQ ID NO: 536117
  misc_feature: HIJSMM301AITAF.8.71.G05.1.454.light.4.raw

SEQ ID NO: 553116 - DNA, 489 bp, Homo sapiens; identical to SEQ ID NO: 535139
  misc_feature: HIJSMM301CEA4G.14.55.E11.1.454.light.4.raw

SEQ ID NO: 553117 - DNA, 489 bp, Homo sapiens
  misc_feature: HIJSMM301BHKI3.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagagtcaaacgaact

SEQ ID NO: 553118 - DNA, 502 bp, Homo sapiens
  misc_feature: HIJSMM301D50NU.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcacca

SEQ ID NO: 553119 - DNA, 489 bp, Homo sapiens; identical to SEQ ID NO: 536663
  misc_feature: HIJSMM301APFCN.16.72.G06.1.454.light.4.raw

SEQ ID NO: 553120 - DNA, 480 bp, Homo sapiens
  misc_feature: HIJSMM301AUIMF.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtcctccctccaccgtgtctgcatccgtaggagacagagtcactatcacctgtcggccagtcagaatattaatagttggttggcctggtatcaccagagaccaggagaacgccccaaagctcatcatttatgatgcctccactttgaatggtggggtcccaccaacgttcagtggcagtggatctgggacagagttcactctcaccatcagcagcctgcagcctgatgatcttggaacttatactgccaacaatataataattattggacgttcggccgagggaccgaaggtcgaaatgagacgaactgtggctgcaccatctgtt

SEQ ID NO: 553121 - DNA, 484 bp, Homo sapiens; identical to SEQ ID NO: 535240
  misc_feature: HIJSMM301BA0P4.47.60.F05.1.454.light.4.raw

SEQ ID NO: 553122 - DNA, 472 bp, Homo sapiens; identical to SEQ ID NO: 536302
  misc_feature: HIJSMM301C969H.18.76.G10.1.454.light.4.raw

SEQ ID NO: 553123 - DNA, 344 bp, Homo sapiens
  misc_feature: HIJSMM301BKIZH.17.28.C06.1.454.light.4.raw
cgtagactagcacgaccggtgctcgatttagagctcacgtattgggtttgggaacctatgaacattctgtaggggccactgtcttccccccgactcctcatctatagaaatgatcatcggccctcccggggtcccgtcgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccctcggtcactctgttcccaccctcctcctagtctacg

SEQ ID NO: 553124 - DNA, 510 bp, Homo sapiens
  misc_feature: HIJSMM301DBJHZ.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtggagtatcaaacgaactgtggctgcaccatctgtcttcta

SEQ ID NO: 553125 - DNA, 513 bp, Homo sapiens
  misc_feature: HIJSMM301AZBLV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgccacggacgaacggtaggaagtcaacgaactagtggcgtgcgaccactctgtcttctatcttcccgtccactctgat

SEQ ID NO: 553126 - DNA, 447 bp, Homo sapiens; identical to SEQ ID NO: 535020
  misc_feature: HIJSMM301EGSH6.18.9.A09.1.454.light.4.raw

SEQ ID NO: 553127 - DNA, 476 bp, Homo sapiens; identical to SEQ ID NO: 544959
  misc_feature: HIJSMM301ATQ44.4.14.B03.1.454.light.4.raw

SEQ ID NO: 553128 - DNA, 486 bp, Homo sapiens; identical to SEQ ID NO: 535043
  misc_feature: HIJSMM301A86DK.46.35.D02.1.454.light.4.raw

SEQ ID NO: 553129 - DNA, 496 bp, Homo sapiens; identical to SEQ ID NO: 535541
  misc_feature: HIJSMM301DQN72.3.33.C11.1.454.light.4.raw

SEQ ID NO: 553130 - DNA, 463 bp, Homo sapiens; identical to SEQ ID NO: 540740
  misc_feature: HIJSMM301A80QY.52.8.A08.1.454.light.4.raw

SEQ ID NO: 553131 - DNA, 486 bp, Homo sapiens; identical to SEQ ID NO: 537840
  misc_feature: HIJSMM301CEKD9.40.81.H04.1.454.light.4.raw

SEQ ID NO: 553132 - DNA, 512 bp, Homo sapiens; identical to SEQ ID NO: 545961
  misc_feature: HIJSMM301EAWBS.14.78.H01.1.454.light.4.raw

SEQ ID NO: 553133 - DNA, 486 bp, Homo sapiens; identical to SEQ ID NO: 535043
  misc_feature: HIJSMM301AD86Q.46.35.D02.1.454.light.4.raw

SEQ ID NO: 553134 - DNA, 514 bp, Homo sapiens; identical to SEQ ID NO: 546238
  misc_feature: HIJSMM301CWSSR.47.85.H08.1.454.light.4.raw

SEQ ID NO: 553135 - DNA, 504 bp, Homo sapiens; identical to SEQ ID NO: 541194
  misc_feature: HIJSMM301D5SE3.27.78.H01.1.454.light.4.raw
  modified_base (431)..(431): a, c, t, g, unknown or other

SEQ ID NO: 553136 - DNA, 508 bp, Homo sapiens
  misc_feature: HIJSMM301AVQCL.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccta

SEQ ID NO: 553137 - DNA, 504 bp, Homo sapiens
  misc_feature: HIJSMM301BNC51.22.21.B10.1.454.light.4.raw
acatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 553138 - DNA, 503 bp, Homo sapiens
  misc_feature: HIJSMM301BSKTD.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtca

SEQ ID NO: 553139 - DNA, 496 bp, Homo sapiens
  misc_feature: HIJSMM301EAAHK.3.33.C11.1.454.light.4.raw
  modified_base (478)..(478): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccnccctcctcgagtgcgtct

SEQ ID NO: 553140 - DNA, 488 bp, Homo sapiens; identical to SEQ ID NO: 537124
  misc_feature: HIJSMM301EFINX.11.25.C03.1.454.light.4.raw

SEQ ID NO: 553141 - DNA, 454 bp, Homo sapiens; identical to SEQ ID NO: 542360
  misc_feature: HIJSMM301A48H0.19.86.H09.1.454.light.4.raw

SEQ ID NO: 553142 - DNA, 490 bp, Homo sapiens; identical to SEQ ID NO: 535420
  misc_feature: HIJSMM301AWMG9.3.72.G06.1.454.light.4.raw

SEQ ID NO: 553143 - DNA, 494 bp, Homo sapiens; identical to SEQ ID NO: 534992
  misc_feature: HIJSMM301B2M3U.9.1.A01.1.454.light.4.raw

SEQ ID NO: 553144 - DNA, 512 bp, Homo sapiens
  misc_feature: HIJSMM301CTHW2.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcctcct

SEQ ID NO: 553145 - DNA, 493 bp, Homo sapiens; identical to SEQ ID NO: 544335
  misc_feature: HIJSMM301CPSZ8.5.57.F02.1.454.light.4.raw

SEQ ID NO: 553146 - DNA, 507 bp, Homo sapiens
  misc_feature: HIJSMM301B8AJT.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtcccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcacttc

SEQ ID NO: 553147 - DNA, 489 bp, Homo sapiens
  misc_feature: HIJSMM301C64UZ.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcacatct

SEQ ID NO: 553148 - DNA, 507 bp, Homo sapiens
  misc_feature: HIJSMM301C5OQ7.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcacgttcggccaagggaccaaggtggaagtcaagcgaactgtggctgcaccatctgtcttcatcttcccgcc

SEQ ID NO: 553149 - DNA, 522 bp, Homo sapiens; identical to SEQ ID NO: 540296
  misc_feature: HIJSMM301AJMXH.5.27.C05.1.454.light.4.raw

SEQ ID NO: 553150 - DNA, 443 bp, Homo sapiens; identical to SEQ ID NO: 537723
  misc_feature: HIJSMM301DFT9N.8.73.G07.1.454.light.4.raw

SEQ ID NO: 553151 - DNA, 520 bp, Homo sapiens
  misc_feature: HIJSMM301D36PI.41.87.H10.1.454.light.4.raw
tctatactatcacgaccggtgctcgatttagcagtactgcgttgggtttgggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctcgccccctcggtccactctgttcccgccct

SEQ ID NO: 553152 - DNA, 495 bp, Homo sapiens; identical to SEQ ID NO: 537415
  misc_feature: HIJSMM301C9BZW.4.27.C05.1.454.light.4.raw

SEQ ID NO: 553153 - DNA, 487 bp, Homo sapiens; identical to SEQ ID NO: 540557
  misc_feature: HIJSMM301BX90R.41.44.D11.1.454.light.4.raw

SEQ ID NO: 553154 - DNA, 479 bp, Homo sapiens; identical to SEQ ID NO: 539141
  misc_feature: HIJSMM301AY7N9.7.67.G01.1.454.light.4.raw

SEQ ID NO: 553155 - DNA, 494 bp, Homo sapiens; identical to SEQ ID NO: 535276
  misc_feature: HIJSMM301B187N.16.6.A06.1.454.light.4.raw

SEQ ID NO: 553156 - DNA, 492 bp, Homo sapiens; identical to SEQ ID NO: 535126
  misc_feature: HIJSMM301AKCVJ.18.11.A11.1.454.light.4.raw

SEQ ID NO: 553157 - DNA, 490 bp, Homo sapiens; identical to SEQ ID NO: 543909
  misc_feature: HIJSMM301C609P.14.55.E11.1.454.light.4.raw

SEQ ID NO: 553158 - DNA, 521 bp, Homo sapiens
  misc_feature: HIJSMM301BHXKM.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctgttcccgccctcctccgtcg

SEQ ID NO: 553159 - DNA, 522 bp, Homo sapiens; identical to SEQ ID NO: 538091
  misc_feature: HIJSMM301CAQGP.27.23.C01.1.454.light.4.raw

SEQ ID NO: 553160 - DNA, 497 bp, Homo sapiens; identical to SEQ ID NO: 536376
  misc_feature: HIJSMM301EFEL3.22.9.A09.1.454.light.4.raw

SEQ ID NO: 553161 - DNA, 516 bp, Homo sapiens
  misc_feature: HIJSMM301B83DW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcacccccggacgttcggtccgaacgggaccgaaggtaggaagtacgaaacgaactagtggcgtgcaccatctgtcttctatcttcccgcccact

SEQ ID NO: 553162 - DNA, 488 bp, Homo sapiens
  misc_feature: HIJSMM301DM359.49.27.C05.1.454.light.4.raw
agtcgagagacacgaccggtgctcgatttagacgcgatcgaagggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacgtaac

SEQ ID NO: 553163 - DNA, 448 bp, Homo sapiens
  misc_feature: HIJSMM301B0X0L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtcttcggatctgggaccaaggtcaccgtcctaagtcagcccaaggcccaacccctctgtcactctcgttcccaccctcctccatactcgta

SEQ ID NO: 553164 - DNA, 506 bp, Homo sapiens; identical to SEQ ID NO: 541287
  misc_feature: HIJSMM301CI22F.19.78.H01.1.454.light.4.raw

SEQ ID NO: 553165 - DNA, 494 bp, Homo sapiens; identical to SEQ ID NO: 539922
  misc_feature: HIJSMM301ALEI8.27.78.H01.1.454.light.4.raw

SEQ ID NO: 553166 - DNA, 491 bp, Homo sapiens; identical to SEQ ID NO: 535194
  misc_feature: HIJSMM301D9FYN.26.78.H01.1.454.light.4.raw

SEQ ID NO: 553167 - DNA, 486 bp, Homo sapiens; identical to SEQ ID NO: 535043
  misc_feature: HIJSMM301AIYVD.46.35.D02.1.454.light.4.raw

SEQ ID NO: 553168 - DNA, 470 bp, Homo sapiens
  misc_feature: HIJSMM301BHPMV.52.32.C10.1.454.light.4.raw
cgcagtacgacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaataccctccatacacttttggccagggaccaagctggagatcagacg

SEQ ID NO: 553169 - DNA, 488 bp, Homo sapiens; identical to SEQ ID NO: 535990
  misc_feature: HIJSMM301AVX7N.11.28.C06.1.454.light.4.raw

SEQ ID NO: 553170 - DNA, 463 bp, Homo sapiens
  misc_feature: HIJSMM301BH4MU.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccgggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 553171 - DNA, 495 bp, Homo sapiens
  misc_feature: HIJSMM301B8PCZ.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaacctgtggctgcaccatctgtt

SEQ ID NO: 553172 - DNA, 504 bp, Homo sapiens
  misc_feature: HIJSMM301DVYQH.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctggaccaggtggagatcaacgaactgtggctgcaccatctgtcttcta

SEQ ID NO: 553173 - DNA, 487 bp, Homo sapiens
  misc_feature: HIJSMM301EXH2X.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtccaggggaccaagctggagatcaaacgaactgtggctgcaccat

SEQ ID NO: 553174 - DNA, 513 bp, Homo sapiens
  misc_feature: HIJSMM301AEOYQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacggaccgaacggtaggaaagtacaaacgaactagtggcgtgcgaccactctgtcttctatctttccccg

SEQ ID NO: 553175 - DNA, 487 bp, Homo sapiens; identical to SEQ ID NO: 536206
  misc_feature: HIJSMM301C9F2Z.47.38.D05.1.454.light.4.raw

SEQ ID NO: 553176 - DNA, 494 bp, Homo sapiens
  misc_feature: HIJSMM301CFF54.40.50.E06.1.454.light.4.raw
tctagcgactcacgaccggtgctcgatttagatctactgacaacacacaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatagttgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgcccccttatgtcttcgggactgggaccaaggtcacagtcctaggtcagcccaagg

SEQ ID NO: 553177 - DNA, 505 bp, Homo sapiens; identical to SEQ ID NO: 538422
  misc_feature: HIJSMM301EPDTR.19.78.H01.1.454.light.4.raw

SEQ ID NO: 553178 - DNA, 494 bp, Homo sapiens; identical to SEQ ID NO: 542264
  misc_feature: HIJSMM301EC3GY.13.6.A06.1.454.light.4.raw

SEQ ID NO: 553179 - DNA, 490 bp, Homo sapiens
  misc_feature: HIJSMM301AV7O5.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtca

SEQ ID NO: 553180 - DNA, 498 bp, Homo sapiens
  misc_feature: HIJSMM301EHFUJ.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctgggacagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcat

SEQ ID NO: 553181 - DNA, 497 bp, Homo sapiens
  misc_feature: HIJSMM301BS1NN.49.17.B06.1.454.light.4.raw
agtcgagagacacgaccggtgctcgatttagtcgatagtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcggggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactcttcg

SEQ ID NO: 553182 - DNA, 505 bp, Homo sapiens; identical to SEQ ID NO: 535503
  misc_feature: HIJSMM301AVW5I.8.28.C06.1.454.light.4.raw

SEQ ID NO: 553183 - DNA, 492 bp, Homo sapiens
  misc_feature: HIJSMM301DF98Z.15.1.A01.1.454.light.4.raw
tctacgtagccacgaccggtgctcgatttagacgtctcatcagggcctgggctcgtgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtcctcctggtaccaacaccaccccggcagagcccccaaactcatgattttatgaggccactaagcgaccctcagggctttctaatcgcttctctggctccaagtctggcaacacggcctccctgacaatctctgggctccgaggctgacgtacgaggctaattattactgctgctcatatgaaggttataacactatactattcggcggagggaccaagctgaccgtcctgcgtcagcccaaggctgccccctcggtcactctcgttcccacccttcctcgctacgtaga

SEQ ID NO: 553184 - DNA, 479 bp, Homo sapiens; identical to SEQ ID NO: 535118
  misc_feature: HIJSMM301A3AVR.13.59.F04.1.454.light.4.raw

SEQ ID NO: 553185 - DNA, 434 bp, Homo sapiens; identical to SEQ ID NO: 535153
  misc_feature: HIJSMM301AHYSF.18.5.A05.1.454.light.4.raw

SEQ ID NO: 553186 - DNA, 468 bp, Homo sapiens
  misc_feature: HIJSMM301CVPOH.40.2.A02.1.454.light.4.raw
tctagcgactcacgaccggtgctcgatttagactcatctacagggggcaggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcgacttttggccagggacctggctggagatcaaacgaactgt

SEQ ID NO: 553187 - DNA, 497 bp, Homo sapiens; identical to SEQ ID NO: 536371
  misc_feature: HIJSMM301AHIHQ.16.78.H01.1.454.light.4.raw

SEQ ID NO: 553188 - DNA, 489 bp, Homo sapiens; identical to SEQ ID NO: 538012
  misc_feature: HIJSMM301AEJ2T.26.23.C01.1.454.light.4.raw

SEQ ID NO: 553189 - DNA, 444 bp, Homo sapiens; identical to SEQ ID NO: 535594
  misc_feature: HIJSMM301EX5RM.9.9.A09.1.454.light.4.raw

SEQ ID NO: 553190 - DNA, 502 bp, Homo sapiens; identical to SEQ ID NO: 537816
  misc_feature: HIJSMM301B6TFL.19.78.H01.1.454.light.4.raw

SEQ ID NO: 553191 - DNA, 508 bp, Homo sapiens
  misc_feature: HIJSMM301A0HYH.48.73.G07.1.454.light.4.raw
agtatacatacacgaccggtgctcgatttagctctacgctcagggcacgaccggtgctcgatttagcacacgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgtaac

SEQ ID NO: 553192 - DNA, 475 bp, Homo sapiens; identical to SEQ ID NO: 537714
  misc_feature: HIJSMM301A1W69.7.81.H04.1.454.light.4.raw

SEQ ID NO: 553193 - DNA, 492 bp, Homo sapiens
  misc_feature: HIJSMM301CI6N4.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgtccg

SEQ ID NO: 553194 - DNA, 457 bp, Homo sapiens
  misc_feature: HIJSMM301EN07G.52.72.G06.1.454.light.4.raw
cgcagtacgacacgaccggtgctcgatttagctacgactgcaagggaaaggggcgtgggtcgtcaggaggcagcgctctcgggacggtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattgggggtttctcatcgcttctccggctccaagtctggcagcacggcctccctgaccatctctgggctccaggctgaggacgaggctgattattactgcagctcatatacaaaacagaaacacttggggtgttcggcggacgggaccaaaactgaccgtcctacgtcagcccaaggctgccccctcggtcactctgttcccaccctcctctatacgatcg

SEQ ID NO: 553195 - DNA, 486 bp, Homo sapiens; identical to SEQ ID NO: 535043
  misc_feature: HIJSMM301BF2HP.46.35.D02.1.454.light.4.raw

SEQ ID NO: 553196 - DNA, 483 bp, Homo sapiens
  misc_feature: HIJSMM301B7VM4.49.82.H05.1.454.light.4.raw
agtcgagagacacgaccggtgctcgatttagtcgagctctctcgcgggcacgaccggtgctcgatttagacacatacgcagggaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctcctgaccatctctgggctccaggctgaggatgaggctcattattattgttgctcatatgcaggcaacttcgctttt

SEQ ID NO: 553197 - DNA, 494 bp, Homo sapiens; identical to SEQ ID NO: 539894
  misc_feature: HIJSMM301AH46I.16.53.E09.1.454.light.4.raw

SEQ ID NO: 553198 - DNA, 497 bp, Homo sapiens; identical to SEQ ID NO: 535664
  misc_feature: HIJSMM301C542B.22.14.B03.1.454.light.4.raw

SEQ ID NO: 553199 - DNA, 508 bp, Homo sapiens
  misc_feature: HIJSMM301C8L99.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgtcccta

SEQ ID NO: 553200 - DNA, 520 bp, Homo sapiens; identical to SEQ ID NO: 537173
  misc_feature: HIJSMM301C252B.27.23.C01.1.454.light.4.raw

SEQ ID NO: 553201 - DNA, 484 bp, Homo sapiens
  misc_feature: HIJSMM301A7NXG.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggcttcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaag

SEQ ID NO: 553202 - DNA, 507 bp, Homo sapiens
  misc_feature: HIJSMM301B7F9I.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttatactgtcaacagcgtagcagcaggcctccggcgacgttcggccaagggaccaaggtggaagtcaagcgaactgtggctgcaccatctgtcttcatcttcccgcc

SEQ ID NO: 553203 - DNA, 505 bp, Homo sapiens
  misc_feature: HIJSMM301EKH5J.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggttcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacg

SEQ ID NO: 553204 - DNA, 498 bp, Homo sapiens
  misc_feature: HIJSMM301AN56O.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagcccgagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtggctgca

SEQ ID NO: 553205 - DNA, 509 bp, Homo sapiens
  misc_feature: HIJSMM301DL1O8.21.26.C04.1.454.light.4.raw
tcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagcctgatgtattttgctagtttattactgccaccaacatgctttcgcaccgctcacgttcggcggagggaccgagggtggagatacaaacgaactgtggctgcacatctgtcttcattccc

SEQ ID NO: 553206 - DNA, 491 bp, Homo sapiens
  misc_feature: HIJSMM301ECI2Z.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagagtcagacgaactgtggctgcaccatctgtcttcta

SEQ ID NO: 553207 - DNA, 496 bp, Homo sapiens; identical to SEQ ID NO: 535660
  misc_feature: HIJSMM301AZRUZ.43.25.C03.1.454.light.4.raw

SEQ ID NO: 553208 - DNA, 444 bp, Homo sapiens; identical to SEQ ID NO: 534993
  misc_feature: HIJSMM301AWL56.5.9.A09.1.454.light.4.raw

SEQ ID NO: 553209 - DNA, 498 bp, Homo sapiens
  misc_feature: HIJSMM301C1RFK.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgatacccccgtggacgttcggccagggaccgaaggtaggaggatcaaacgaactagtggctgcaccatctgtcttcatcttcccg

SEQ ID NO: 553210 - DNA, 488 bp, Homo sapiens
  misc_feature: HIJSMM301BM17G.43.33.C11.1.454.light.4.raw
tgtgagtagtcacgaccggtgctcgatttagagtgagctcgttgggtttgggggcagaagtctctctcagtcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtcaagcgaacctgtggctg

SEQ ID NO: 553211 - DNA, 497 bp, Homo sapiens; identical to SEQ ID NO: 535740
  misc_feature: HIJSMM301CAR9A.3.71.G05.1.454.light.4.raw

SEQ ID NO: 553212 - DNA, 492 bp, Homo sapiens
  misc_feature: HIJSMM301EHJVJ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcgatttattactgtcagcagtataataactggcctccacggtacacttttggccaggggaccaagctggagatcaaacgaactgtggctgcaccat

SEQ ID NO: 553213 - DNA, 479 bp, Homo sapiens
  misc_feature: HIJSMM301DCWPN.13.5.A05.1.454.light.4.raw
tcacgtactacacgaccggtgctcgatttagatagatagacagggggtgggtccaggaggcagaactctgggtgtctcaccatggcctggatccctctacttctccccctcctcactctctgcacagctctgaggcctcgtatgagctgacacagccactctcggtgtcagtgtccccaggacagacggccaggatcacctgctctgcagatgcattgccataacattttgcttattgctgtcagcagaaaccaggccaggccaggccaggcccctatattcctgatataaaaagacattgaggggccctcagtgatccctgagcgattctctggctccatctcagggacaacagtcacgttgaccatcagtggagtccaggcagaggacgaggctgactgttagtgactttcagcagacaacagtggacttccgtgattttcgacggagggaccaaactgaccgtcctgcgtcagccc

SEQ ID NO: 553214 - DNA, 447 bp, Homo sapiens; identical to SEQ ID NO: 535020
  misc_feature: HIJSMM301BJRGO.18.9.A09.1.454.light.4.raw

SEQ ID NO: 553215 - DNA, 488 bp, Homo sapiens; identical to SEQ ID NO: 540827
  misc_feature: HIJSMM301AMNJE.15.49.E05.1.454.light.4.raw

SEQ ID NO: 553216 - DNA, 492 bp, Homo sapiens
  misc_feature: HIJSMM301C7UR4.10.33.C11.1.454.light.4.raw
  modified_base (359)..(359): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacagggtcccatcaaggttcagtggaggtggatctgggacagattttacnctcggcatccgcagcctgcagcctgaagattttgcgacatattactgtcaacagtatgaaaatgtcccgctcactttcggcgggggaccaaggtggagttcaacgaactgtggctgcaccatctgtcttcatt

SEQ ID NO: 553217 - DNA, 510 bp, Homo sapiens; identical to SEQ ID NO: 535474
  misc_feature: HIJSMM301ALS9Y.17.33.C11.1.454.light.4.raw

SEQ ID NO: 553218 - DNA, 474 bp, Homo sapiens
  misc_feature: HIJSMM301C47PO.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatccttcccgccatctgagacacgcgag

SEQ ID NO: 553219 - DNA, 516 bp, Homo sapiens; identical to SEQ ID NO: 535549
  misc_feature: HIJSMM301AFU1N.14.70.G04.1.454.light.4.raw

SEQ ID NO: 553220 - DNA, 489 bp, Homo sapiens
  misc_feature: HIJSMM301DOYDW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggaggatcagacgaactgtggctgcaccatctgtcttca

SEQ ID NO: 553221 - DNA, 483 bp, Homo sapiens
  misc_feature: HIJSMM301DKWHR.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaactgtgctgcaccatctgt

SEQ ID NO: 553222 - DNA, 447 bp, Homo sapiens; identical to SEQ ID NO: 535020
  misc_feature: HIJSMM301BRLKJ.18.9.A09.1.454.light.4.raw

SEQ ID NO: 553223 - DNA, 483 bp, Homo sapiens
  misc_feature: HIJSMM301ERHL2.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacat

SEQ ID NO: 553224 - DNA, 508 bp, Homo sapiens; identical to SEQ ID NO: 536388
  misc_feature: HIJSMM301D29MX.11.57.F02.1.454.light.4.raw

SEQ ID NO: 553225 - DNA, 502 bp, Homo sapiens; identical to SEQ ID NO: 541501
  misc_feature: HIJSMM301BX01U.17.27.C05.1.454.light.4.raw

SEQ ID NO: 553226 - DNA, 497 bp, Homo sapiens
  misc_feature: HIJSMM301DACNR.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaaggctggagatcaaacgaactgtggctgcaccatctgt

SEQ ID NO: 553227 - DNA, 516 bp, Homo sapiens
  misc_feature: HIJSMM301CWUYK.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggaccaggctgaccgtcctaggtcagccaaggctgcccctcggtcactctgttccacct

SEQ ID NO: 553228 - DNA, 504 bp, Homo sapiens
  misc_feature: HIJSMM301DFQ92.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttcacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcac

SEQ ID NO: 553229 - DNA, 505 bp, Homo sapiens; identical to SEQ ID NO: 546412
  misc_feature: HIJSMM301CI2BA.22.21.B10.1.454.light.4.raw

SEQ ID NO: 553230 - DNA, 492 bp, Homo sapiens; identical to SEQ ID NO: 536010
  misc_feature: HIJSMM301C32U2.10.20.B09.1.454.light.4.raw

SEQ ID NO: 553231 - DNA, 517 bp, Homo sapiens
  misc_feature: HIJSMM301ECSJ1.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctctcacg

SEQ ID NO: 553232 - DNA, 493 bp, Homo sapiens; identical to SEQ ID NO: 535770
  misc_feature: HIJSMM301B6JRD.51.71.G05.1.454.light.4.raw

SEQ ID NO: 553233 - DNA, 485 bp, Homo sapiens; identical to SEQ ID NO: 535880
  misc_feature: HIJSMM301DZG2V.7.75.G09.1.454.light.4.raw

SEQ ID NO: 553234 - DNA, 488 bp, Homo sapiens; identical to SEQ ID NO: 541868
  misc_feature: HIJSMM301C7Z37.14.55.E11.1.454.light.4.raw

SEQ ID NO: 553235 - DNA, 496 bp, Homo sapiens; identical to SEQ ID NO: 535109
  misc_feature: HIJSMM301C8WHI.16.78.H01.1.454.light.4.raw

SEQ ID NO: 553236 - DNA, 503 bp, Homo sapiens; identical to SEQ ID NO: 537189
  misc_feature: HIJSMM301EX5QI.19.85.H08.1.454.light.4.raw

SEQ ID NO: 553237 - DNA, 501 bp, Homo sapiens; identical to SEQ ID NO: 535746
  misc_feature: HIJSMM301DSU04.18.11.A11.1.454.light.4.raw

SEQ ID NO: 553238 - DNA, 478 bp, Homo sapiens
  misc_feature: HIJSMM301AJ8SU.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaagtggatgtcaaccgaactagtggctgcaccta

SEQ ID NO: 553239 - DNA, 501 bp, Homo sapiens; identical to SEQ ID NO: 548482
  misc_feature: HIJSMM301ARTIS.41.71.G05.1.454.light.4.raw

SEQ ID NO: 553240 - DNA, 506 bp, Homo sapiens
  misc_feature: HIJSMM301EFI0N.19.71.G05.1.454.light.4.raw
  modified_base (164)..(164): a, c, t, g, unknown or other
tactctcgtgcacgaccggtgctcgatttagtgtcgtcgcaagagagaggggggaggtacaacaggcaggcaggggcagcaagaatggtgttgcagacccaggtcttcatttcttctgttgctctggatctctggtgcccacggggacgatcgtgatgacccangtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcctaacgggaccgaacggtaggagtattacagacgaacgtagtgg

SEQ ID NO: 553241 - DNA, 344 bp, Homo sapiens
  misc_feature: HIJSMM301DEL71.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggtcactctgttcccgccctcctccgagcgacga

SEQ ID NO: 553242 - DNA, 485 bp, Homo sapiens; identical to SEQ ID NO: 536075
  misc_feature: HIJSMM301AZYGT.17.21.B10.1.454.light.4.raw

SEQ ID NO: 553243 - DNA, 514 bp, Homo sapiens
  misc_feature: HIJSMM301DY3IH.49.38.D05.1.454.light.4.raw
agtcgagagacacgaccggtgctcgatttagtatctgatagttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttccca

SEQ ID NO: 553244 - DNA, 499 bp, Homo sapiens
  misc_feature: HIJSMM301B5L1W.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctcgtacacctttggccaggggaccaagctggagatcaaacgaactgtggctgcaccatctgtcttcatt

SEQ ID NO: 553245 - DNA, 405 bp, Homo sapiens
  misc_feature: HIJSMM301DL2OI.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactactgttcccaccctcctcctacagtgct

SEQ ID NO: 553246 - DNA, 510 bp, Homo sapiens
  misc_feature: HIJSMM301BUDFU.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttacgtaagctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccgggggccactttcggccctgggaccaaggtggagatcaaacgaactagtggctgcaccactctgtcttcta

SEQ ID NO: 553247 - DNA, 498 bp, Homo sapiens
  misc_feature: HIJSMM301A17R0.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctcg

SEQ ID NO: 553248 - DNA, 501 bp, Homo sapiens
  misc_feature: HIJSMM301ECHJW.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccatgtca

SEQ ID NO: 553249 - DNA, 505 bp, Homo sapiens; identical to SEQ ID NO: 538422
  misc_feature: HIJSMM301CCK1P.19.78.H01.1.454.light.4.raw

SEQ ID NO: 553250 - DNA, 497 bp, Homo sapiens
  misc_feature: HIJSMM301DWJQS.27.78.H01.1.454.light.4.raw
  modified_base (464)..(464): a, c, t, g, unknown or other
agcgtcgtctcacgaccggtgctcgatttagtgtgagtagtttggggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagttgatcaccttcggccaagggacacgactgganattaaacgaactgtggctgcaccatcctgtctt

SEQ ID NO: 553251 - DNA, 512 bp, Homo sapiens
  misc_feature: HIJSMM301C40SX.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtctaggtcagcccaaggccaaccccactgtccactctgttcccacctcctcga

SEQ ID NO: 553252 - DNA, 492 bp, Homo sapiens; identical to SEQ ID NO: 535426
  misc_feature: HIJSMM301D7A0N.47.78.H01.1.454.light.4.raw

SEQ ID NO: 553253 - DNA, 492 bp, Homo sapiens
  misc_feature: HIJSMM301BC9DJ.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctaggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgtt

SEQ ID NO: 553254 - DNA, 489 bp, Homo sapiens; identical to SEQ ID NO: 535139
  misc_feature: HIJSMM301DKZ8W.14.55.E11.1.454.light.4.raw

SEQ ID NO: 553255 - DNA, 469 bp, Homo sapiens
  misc_feature: HIJSMM301DLWBJ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctggactgaagtgcatatgaagagaactgtgg

SEQ ID NO: 553256 - DNA, 486 bp, Homo sapiens; identical to SEQ ID NO: 535043
  misc_feature: HIJSMM301D8R66.46.35.D02.1.454.light.4.raw

SEQ ID NO: 553257 - DNA, 501 bp, Homo sapiens; identical to SEQ ID NO: 550139
  misc_feature: HIJSMM301CSK86.15.56.F01.1.454.light.4.raw

SEQ ID NO: 553258 - DNA, 504 bp, Homo sapiens
  misc_feature: HIJSMM301CSLU4.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactggggacgaggccgactattactgcggagcatgggatagcagcctgaacactgtgtcttcggcggagggaccaagctgaccgtccttagtcagcccaagg

SEQ ID NO: 553259 - DNA, 518 bp, Homo sapiens
  misc_feature: HIJSMM301DOHI3.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctccggtcactctgttcccaccctcctcacta

SEQ ID NO: 553260 - DNA, 447 bp, Homo sapiens; identical to SEQ ID NO: 535020
  misc_feature: HIJSMM301E3VNW.18.9.A09.1.454.light.4.raw

SEQ ID NO: 553261 - DNA, 508 bp, Homo sapiens
  misc_feature: HIJSMM301EVXK1.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccgaaaggtagggaaagtaacaaacgaaaacctagtggctgcacca

SEQ ID NO: 553262 - DNA, 497 bp, Homo sapiens
  misc_feature: HIJSMM301DR0QL.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgactgtggctgcaccatctgtcttcta

SEQ ID NO: 553263 - DNA, 484 bp, Homo sapiens
  misc_feature: HIJSMM301BCBWW.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcggagggaccaaggtggagatcaaacgaa

SEQ ID NO: 553264 - DNA, 517 bp, Homo sapiens
  misc_feature: HIJSMM301DI3X6.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctcgttcccgccctcctct

SEQ ID NO: 553265 - DNA, 442 bp, Homo sapiens
  misc_feature: HIJSMM301BT77O.49.22.B11.1.454.light.4.raw
agtcgagagacacgaccggtgctcgatttagacgacagctcaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaacctggccaggttcccaggctcctcgtctatgatgcgtccatcagggccactggcatcccagccaggttcagtggcagtgggtctgggacagacttcactctcaccttcggccaagggacacgactggaaattaaacgaactgtggctgcaccatctgtcttcatcttcccgccatctgatctctcgact

SEQ ID NO: 553266 - DNA, 491 bp, Homo sapiens
  misc_feature: HIJSMM301AZO41.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtaggaaagtacaaacgaaactagtggctgcacca

SEQ ID NO: 553267 - DNA, 501 bp, Homo sapiens; identical to SEQ ID NO: 542101
  misc_feature: HIJSMM301CD2J7.14.57.F02.1.454.light.4.raw

SEQ ID NO: 553268 - DNA, 487 bp, Homo sapiens; identical to SEQ ID NO: 539157
  misc_feature: HIJSMM301BDX98.26.37.D04.1.454.light.4.raw

SEQ ID NO: 553269 - DNA, 493 bp, Homo sapiens
  misc_feature: HIJSMM301DPKXJ.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccccgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtctt

SEQ ID NO: 553270 - DNA, 478 bp, Homo sapiens; identical to SEQ ID NO: 541928
  misc_feature: HIJSMM301DK4ML.7.76.G10.1.454.light.4.raw

SEQ ID NO: 553271 - DNA, 492 bp, Homo sapiens; identical to SEQ ID NO: 534967
  misc_feature: HIJSMM301DM2Y2.47.64.F09.1.454.light.4.raw

SEQ ID NO: 553272 - DNA, 501 bp, Homo sapiens
  misc_feature: HIJSMM301BHLP2.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccta

SEQ ID NO: 553273 - DNA, 485 bp, Homo sapiens
  misc_feature: HIJSMM301DX3VH.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggtaccaaggtggagatcaaacgaa

SEQ ID NO: 553274 - DNA, 479 bp, Homo sapiens; identical to SEQ ID NO: 535586
  misc_feature: HIJSMM301B8XB4.13.34.D01.1.454.light.4.raw

SEQ ID NO: 553275 - DNA, 498 bp, Homo sapiens
  misc_feature: HIJSMM301BS234.48.23.C01.1.454.light.4.raw
agtatacatacacgaccggtgctcgatttagtacacgtgattagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 553276 - DNA, 485 bp, Homo sapiens; identical to SEQ ID NO: 547003
  misc_feature: HIJSMM301CYF7E.40.83.H06.1.454.light.4.raw

SEQ ID NO: 553277 - DNA, 489 bp, Homo sapiens
  misc_feature: HIJSMM301C0BVH.40.27.C05.1.454.light.4.raw
tctagcgactcacgaccggtgctcgatttagacgcgatcgaagggtttggggggggtcgtcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggcgtccagactgaggatgaggctacttatttttgtctgctcttatgcaggcagtttcgctctcgaagtgttcggcggagggaccgagctgaccgtcctacgtcgg

SEQ ID NO: 553278 - DNA, 501 bp, Homo sapiens; identical to SEQ ID NO: 537793
  misc_feature: HIJSMM301A1FQA.15.37.D04.1.454.light.4.raw

SEQ ID NO: 553279 - DNA, 506 bp, Homo sapiens
  misc_feature: HIJSMM301B5UFV.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctcg

SEQ ID NO: 553280 - DNA, 514 bp, Homo sapiens
  misc_feature: HIJSMM301A17JK.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggtcccgtcggaccgaacggtggagagtcaaacgaaactgtggctgcaccactctgtcttcta

SEQ ID NO: 553281 - DNA, 490 bp, Homo sapiens; identical to SEQ ID NO: 538273
  misc_feature: HIJSMM301AEMDU.16.73.G07.1.454.light.4.raw

SEQ ID NO: 553282 - DNA, 521 bp, Homo sapiens
  misc_feature: HIJSMM301D6BQ8.27.23.C01.1.454.light.4.raw
  modified_base (506)..(506): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcnctctgttcccaccct

SEQ ID NO: 553283 - DNA, 498 bp, Homo sapiens
  misc_feature: HIJSMM301C0U9Q.48.28.C06.1.454.light.4.raw
agtatacatacacgaccggtgctcgatttagagctcacgtattgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 553284 - DNA, 513 bp, Homo sapiens
  misc_feature: HIJSMM301ELL07.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggccgaaggaccgaaggtaggaaggtacaaacgaactagtggcgtgcaccactctgtcttctatcttcccgtccact

SEQ ID NO: 553285 - DNA, 492 bp, Homo sapiens
  misc_feature: HIJSMM301B7ILG.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacgatcaagcgaactgtggctgcaccatctgtt

SEQ ID NO: 553286 - DNA, 493 bp, Homo sapiens; identical to SEQ ID NO: 548028
  misc_feature: HIJSMM301D9YEC.19.83.H06.1.454.light.4.raw

SEQ ID NO: 553287 - DNA, 497 bp, Homo sapiens
  misc_feature: HIJSMM301EF7CG.40.4.A04.1.454.light.4.raw
tctagcgactcacgaccggtgctcgatttagagtagtgatcagggggaactgagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggccaagggaccaaggtggagatcaaacgaactgtggctgcacc

SEQ ID NO: 553288 - DNA, 480 bp, Homo sapiens
  misc_feature: HIJSMM301EGWNB.49.44.D11.1.454.light.4.raw
agtcgagagacacgaccggtgctcgatttagcgcagtacgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtggaagtggctctgggacagattttactttctaccatcagcaggctgcagcctgaagatattgcaacatattactgtcaacagtatgatagtctcccgcctcactttcggtcgggggaccgaaggtggagatcaagcgaacgtgtggctgcacca

SEQ ID NO: 553289 - DNA, 494 bp, Homo sapiens; identical to SEQ ID NO: 534992
  misc_feature: HIJSMM301BAIZ9.9.1.A01.1.454.light.4.raw

SEQ ID NO: 553290 - DNA, 488 bp, Homo sapiens; identical to SEQ ID NO: 535861
  misc_feature: HIJSMM301DQ4MB.14.55.E11.1.454.light.4.raw

SEQ ID NO: 553291 - DNA, 489 bp, Homo sapiens
  misc_feature: HIJSMM301DQXK8.51.29.C07.1.454.light.4.raw
cgatcgtatacacgaccggtgctcgatttagagtgctacgaagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttcccgccatctgatcgtagcact

SEQ ID NO: 553292 - DNA, 486 bp, Homo sapiens
  misc_feature: HIJSMM301BV7UK.48.28.C06.1.454.light.4.raw
agtatacatacacgaccggtgctcgatttagagctcacgtattgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 553293 - DNA, 479 bp, Homo sapiens
  misc_feature: HIJSMM301ANNKA.9.76.G10.1.454.light.4.raw
tgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtcctaggtcagcccaa

SEQ ID NO: 553294 - DNA, 488 bp, Homo sapiens; identical to SEQ ID NO: 535081
  misc_feature: HIJSMM301C5T1U.26.23.C01.1.454.light.4.raw

SEQ ID NO: 553295 - DNA, 497 bp, Homo sapiens; identical to SEQ ID NO: 536376
  misc_feature: HIJSMM301DFIE7.22.9.A09.1.454.light.4.raw

SEQ ID NO: 553296 - DNA, 498 bp, Homo sapiens
  misc_feature: HIJSMM301D6P41.48.77.G11.1.454.light.4.raw
agtatacatacacgaccggtgctcgatttagctagtcactcaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 553297 - DNA, 505 bp, Homo sapiens
  misc_feature: HIJSMM301CU75V.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgagttttcggcgggggaccgaggctgaccgtcggcggtcagcccaaggctcgccccctcggtccactcctgttcccta

SEQ ID NO: 553298 - DNA, 511 bp, Homo sapiens; identical to SEQ ID NO: 550310
  misc_feature: HIJSMM301AVI8W.11.57.F02.1.454.light.4.raw

SEQ ID NO: 553299 - DNA, 503 bp, Homo sapiens
  misc_feature: HIJSMM301EX7PX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagtgaccaaggtagggaaatacaaacgaaacctagtggctgcaccatctgtcttctatt

SEQ ID NO: 553300 - DNA, 447 bp, Homo sapiens; identical to SEQ ID NO: 541817
  misc_feature: HIJSMM301CWEII.18.9.A09.1.454.light.4.raw

SEQ ID NO: 553301 - DNA, 500 bp, Homo sapiens
  misc_feature: HIJSMM301DWRNP.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagttttattattgtcaccagttattatagttggcctccggtggacgttcggccaagggaccaaggtaggaatacaaacgaactgtggctgcaccatctgtctt

SEQ ID NO: 553302 - DNA, 485 bp, Homo sapiens; identical to SEQ ID NO: 534977
  misc_feature: HIJSMM301A1IZ3.15.28.C06.1.454.light.4.raw

SEQ ID NO: 553303 - DNA, 497 bp, Homo sapiens
  misc_feature: HIJSMM301AGQ41.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtaggagatcaaacgaactagtggctgcaccactctgtt

SEQ ID NO: 553304 - DNA, 417 bp, Homo sapiens
  misc_feature: HIJSMM301AUQ8K.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttcccgccctcctccatactcgta

SEQ ID NO: 553305 - DNA, 493 bp, Homo sapiens
  misc_feature: HIJSMM301CPVGZ.52.51.E07.1.454.light.4.raw
cgcagtacgacacgaccggtgctcgatttagcatactctacaacacacaaagggggagctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaaggtggagatcaacgaactgtgg

SEQ ID NO: 553306 - DNA, 503 bp, Homo sapiens
  misc_feature: HIJSMM301AWPRN.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccgaagctgaccgtcctaggtcagcccaaggctgccccctcggtcactc

SEQ ID NO: 553307 - DNA, 502 bp, Homo sapiens
  misc_feature: HIJSMM301C5K87.48.28.C06.1.454.light.4.raw
agtatacatacacgaccggtgctcgatttagagctcacgtattgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccccg

SEQ ID NO: 553308 - DNA, 507 bp, Homo sapiens
  misc_feature: HIJSMM301EM6B5.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcacttttcggcggagggaccaaggtggaggatcaaacgaactgtggctgcaccatctgt

SEQ ID NO: 553309 - DNA, 513 bp, Homo sapiens
  misc_feature: HIJSMM301C5OHF.15.86.H09.1.454.light.4.raw
tctacgtagccacgaccggtgctcgatttagtgctatagacttgggtttgggggacttccctggtctccttctacctactgcccttcatttctccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttggggtgttcggcggagggaccaagctgaccgtcctaggtcagcccaaggctgccccctcggtcactctgttcccaccctcctcgctacgtaga

SEQ ID NO: 553310 - DNA, 489 bp, Homo sapiens; identical to SEQ ID NO: 546040
  misc_feature: HIJSMM301BN04R.11.12.B01.1.454.light.4.raw

SEQ ID NO: 553311 - DNA, 489 bp, Homo sapiens; identical to SEQ ID NO: 535139
  misc_feature: HIJSMM301EP7JS.14.55.E11.1.454.light.4.raw

SEQ ID NO: 553312 - DNA, 513 bp, Homo sapiens; identical to SEQ ID NO: 547639
  misc_feature: HIJSMM301CUK08.43.59.F04.1.454.light.4.raw

SEQ ID NO: 553313 - DNA, 505 bp, Homo sapiens
  misc_feature: HIJSMM301CAHQ0.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcacctctgttccccgccctcctcta

SEQ ID NO: 553314 - DNA, 500 bp, Homo sapiens
  misc_feature: HIJSMM301AKD8Z.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggacggaggatcagacgaactagtggcgtgtcaccactctcgttcgttcta

SEQ ID NO: 553315 - DNA, 502 bp, Homo sapiens
  misc_feature: HIJSMM301ARV4N.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccagggtggaaatcaaacgaactgtggctgcaccatctgtcttctatcttccccgccact

SEQ ID NO: 553316 - DNA, 500 bp, Homo sapiens
  misc_feature: HIJSMM301BOX79.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtctccatt

SEQ ID NO: 553317 - DNA, 507 bp, Homo sapiens; identical to SEQ ID NO: 535455
  misc_feature: HIJSMM301AJ0N5.8.28.C06.1.454.light.4.raw

SEQ ID NO: 553318 - DNA, 454 bp, Homo sapiens; identical to SEQ ID NO: 535005
  misc_feature: HIJSMM301DV847.19.86.H09.1.454.light.4.raw

SEQ ID NO: 553319 - DNA, 447 bp, Homo sapiens; identical to SEQ ID NO: 535020
  misc_feature: HIJSMM301A5010.18.9.A09.1.454.light.4.raw

SEQ ID NO: 553320 - DNA, 523 bp, Homo sapiens
  misc_feature: HIJSMM301A8CC1.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttacgttcggacgggacggaaccgagggacggagtactacgaacgaacgtaacgtggtcggtcgtcgacccaacctacttcgttcgttctta

SEQ ID NO: 553321 - DNA, 486 bp, Homo sapiens; identical to SEQ ID NO: 541357
  misc_feature: HIJSMM301DV1Y6.17.26.C04.1.454.light.4.raw

SEQ ID NO: 553322 - DNA, 494 bp, Homo sapiens; identical to SEQ ID NO: 539065
  misc_feature: HIJSMM301BGP9E.11.81.H04.1.454.light.4.raw

SEQ ID NO: 553323 - DNA, 516 bp, Homo sapiens; identical to SEQ ID NO: 552129
  misc_feature: HIJSMM301DHOO5.27.23.C01.1.454.light.4.raw

SEQ ID NO: 553324 - DNA, 517 bp, Homo sapiens
  misc_feature: HIJSMM301AP0NY.51.60.F05.1.454.light.4.raw
cgatcgtatacacgaccggtgctcgatttagtacgtcatcagggaaaggggagagaagacaggattcaggacaatctccagcatggccggcttccctctcctcctcaccctccgcactcactgtgcagggtcctgggcccagtctgtactgactcagccaccctcagcgtctgggacccccgggcagagggtcaccatctcttgttctggaagcagctgccatatcgaaaataattctgaatactggtaccatcacctcccaggaacggcccccaaattcctcattgataggaataatcagcggccctcaggggtcccggaccgattctctggctccaagtctggcacctcagcctccctggccatcagtgggctccggtccgaggatgagactgattattattgtgcaacatgggatgacagcctgagtggtcggaagtggcgttcggcggagggaccaagctgaccgtcctacgtcagcccaaggctgccccctcggtcactctgttcccgccct

SEQ ID NO: 553325 - DNA, 488 bp, Homo sapiens; identical to SEQ ID NO: 540827
  misc_feature: HIJSMM301AJZLS.15.49.E05.1.454.light.4.raw

SEQ ID NO: 553326 - DNA, 501 bp, Homo sapiens; identical to SEQ ID NO: 535746
  misc_feature: HIJSMM301EMN7P.18.11.A11.1.454.light.4.raw

SEQ ID NO: 553327 - DNA, 479 bp, Homo sapiens; identical to SEQ ID NO: 535118
  misc_feature: HIJSMM301BP84Y.13.59.F04.1.454.light.4.raw

SEQ ID NO: 553328 - DNA, 506 bp, Homo sapiens
  misc_feature: HIJSMM301DAWZE.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggtcggagggaccaagttgaccgccctaggtcagcccaaggctccg

SEQ ID NO: 553329 - DNA, 416 bp, Homo sapiens; identical to SEQ ID NO: 539343
  misc_feature: HIJSMM301BOENV.18.78.H01.1.454.light.4.raw

SEQ ID NO: 553330 - DNA, 486 bp, Homo sapiens; identical to SEQ ID NO: 535385
  misc_feature: HIJSMM301CZJUM.19.71.G05.1.454.light.4.raw

SEQ ID NO: 553331 - DNA, 512 bp, Homo sapiens; identical to SEQ ID NO: 550704
  misc_feature: HIJSMM301AJJVL.15.76.G10.1.454.light.4.raw

SEQ ID NO: 553332 - DNA, 518 bp, Homo sapiens; identical to SEQ ID NO: 539372
  misc_feature: HIJSMM301D7Z2Q.7.86.H09.1.454.light.4.raw

SEQ ID NO: 553333 - DNA, 477 bp, Homo sapiens
  misc_feature: HIJSMM301DU7AP.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagtttggccaggggaccaagctggagatcaaacga

SEQ ID NO: 553334 - DNA, 501 bp, Homo sapiens; identical to SEQ ID NO: 542101
  misc_feature: HIJSMM301EMI49.14.57.F02.1.454.light.4.raw

SEQ ID NO: 553335 - DNA, 494 bp, Homo sapiens; identical to SEQ ID NO: 534992
  misc_feature: HIJSMM301DT03A.9.1.A01.1.454.light.4.raw

SEQ ID NO: 553336 - DNA, 494 bp, Homo sapiens
  misc_feature: HIJSMM301DCR0M.27.78.H01.1.454.light.4.raw
  modified_base (379)..(379): a, c, t, g, unknown or other
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactgganattaaacgaactgtggctgcaccatctgtctt

SEQ ID NO: 553337 - DNA, 449 bp, Homo sapiens
  misc_feature: HIJSMM301A1QBS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagccctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcgta

SEQ ID NO: 553338 - DNA, 494 bp, Homo sapiens
  misc_feature: HIJSMM301DW7B3.19.71.G05.1.454.light.4.raw
tactctcgtgcacgaccggtgctcgatttagtgtcgtcgcaagagagaggaggtacaacaggcaggcaggggcagcaagatggtgttgtagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatacagacgaactgtggctgca

SEQ ID NO: 553339 - DNA, 500 bp, Homo sapiens
  misc_feature: HIJSMM301D3IN3.3.35.D02.1.454.light.4.raw
agacgcactccacgaccggtgctcgatttagcacacgatagttgggtttggggtgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggcctaggggaccaagctggagatcaaacgaactagtggctgcacca

SEQ ID NO: 553340 - DNA, 508 bp, Homo sapiens
  misc_feature: HIJSMM301BT0LC.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccaacggaccgaaggtacggaaatacaagacgaactagtggctgcgaccatctgtcttcatcttccgt

SEQ ID NO: 553341 - DNA, 490 bp, Homo sapiens; identical to SEQ ID NO: 535420
  misc_feature: HIJSMM301DK9FO.3.72.G06.1.454.light.4.raw

SEQ ID NO: 553342 - DNA, 497 bp, Homo sapiens; identical to SEQ ID NO: 536376
  misc_feature: HIJSMM301CM96H.22.9.A09.1.454.light.4.raw

SEQ ID NO: 553343 - DNA, 479 bp, Homo sapiens
  misc_feature: HIJSMM301BZJ4D.43.12.B01.1.454.light.4.raw
tgtgagtagtcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcacc

SEQ ID NO: 553344 - DNA, 500 bp, Homo sapiens; identical to SEQ ID NO: 541228
  misc_feature: HIJSMM301EJCEE.13.11.A11.1.454.light.4.raw

SEQ ID NO: 553345 - DNA, 496 bp, Homo sapiens; identical to SEQ ID NO: 535541
  misc_feature: HIJSMM301CUO1A.3.33.C11.1.454.light.4.raw

SEQ ID NO: 553346 - DNA, 495 bp, Homo sapiens; identical to SEQ ID NO: 538269
  misc_feature: HIJSMM301AW0MU.9.1.A01.1.454.light.4.raw

SEQ ID NO: 553347 - DNA, 494 bp, Homo sapiens; identical to SEQ ID NO: 535629
  misc_feature: HIJSMM301AZI2R.4.27.C05.1.454.light.4.raw

SEQ ID NO: 553348 - DNA, 494 bp, Homo sapiens; identical to SEQ ID NO: 539006
  misc_feature: HIJSMM301DN2EI.48.1.A01.1.454.light.4.raw

SEQ ID NO: 553349 - DNA, 485 bp, Homo sapiens
  misc_feature: HIJSMM301BGZQC.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggttattactgcatgcaagttctacaaacttcctacacttttggccaggggaccaagctggagatcaaacgaa

SEQ ID NO: 553350 - DNA, 377 bp, Homo sapiens; identical to SEQ ID NO: 536071
  misc_feature: HIJSMM301A1B2V.40.9.A09.1.454.light.4.raw

SEQ ID NO: 553351 - DNA, 503 bp, Homo sapiens; identical to SEQ ID NO: 538884
  misc_feature: HIJSMM301DW1SH.27.78.H01.1.454.light.4.raw

SEQ ID NO: 553352 - DNA, 507 bp, Homo sapiens
  misc_feature: HIJSMM301C4VLK.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcacgttcggccaagggaccaaggtggaagtcaagcgaactgtggctgcaccatctgtcttcatcttcccgcc

SEQ ID NO: 553353 - DNA, 520 bp, Homo sapiens; identical to SEQ ID NO: 544672
  misc_feature: HIJSMM301A6VQV.27.23.C01.1.454.light.4.raw

SEQ ID NO: 553354 - DNA, 517 bp, Homo sapiens
  misc_feature: HIJSMM301CBJC2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaagggaccgaacggtaggaagtacgaaacgaactagtggctgcaccatctgtcttctactcttcccgccctact

SEQ ID NO: 553355 - DNA, 497 bp, Homo sapiens; identical to SEQ ID NO: 536807
  misc_feature: HIJSMM301BT6SW.10.37.D04.1.454.light.4.raw

SEQ ID NO: 553356 - DNA, 508 bp, Homo sapiens
  misc_feature: HIJSMM301EQJJQ.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctcgccccctcggt

SEQ ID NO: 553357 - DNA, 503 bp, Homo sapiens; identical to SEQ ID NO: 543299
  misc_feature: HIJSMM301CREYC.48.36.D03.1.454.light.4.raw

SEQ ID NO: 553358 - DNA, 519 bp, Homo sapiens; identical to SEQ ID NO: 549998
  misc_feature: HIJSMM301BMJ1F.48.24.C02.1.454.light.4.raw

SEQ ID NO: 553359 - DNA, 496 bp, Homo sapiens
  misc_feature: HIJSMM301CR7VF.16.12.B01.1.454.light.4.raw
  modified_base (437)..(437): a, c, t, g, unknown or other
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggnggaggaccaagttgaccgtcctaggtcagcccaaggctgccccctcggtcactcttccg

SEQ ID NO: 553360 - DNA, 512 bp, Homo sapiens; identical to SEQ ID NO: 539813
  misc_feature: HIJSMM301B2ZZ4.14.7.A07.1.454.light.4.raw

SEQ ID NO: 553361 - DNA, 485 bp, Homo sapiens; identical to SEQ ID NO: 539315
  misc_feature: HIJSMM301A7G54.3.88.H11.1.454.light.4.raw

SEQ ID NO: 553362 - DNA, 487 bp, Homo sapiens
  misc_feature: HIJSMM301DN2FW.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagctaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgt

SEQ ID NO: 553363 - DNA, 485 bp, Homo sapiens
  misc_feature: HIJSMM301CUD6D.15.1.A01.1.454.light.4.raw
tctacgtagccacgaccggtgctcgatttagacgtctcatcagggcctgggctctgctgctcctcactctcctcactcaggacacagggtactgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 553364 - DNA, 506 bp, Homo sapiens
  misc_feature: HIJSMM301ED2FS.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccacctgaccatcagcgcggtcgaagccggagatgaggccgactattactgtcaggtgtgggacagtaatagtgatcccgagcaggttttcggcggtgggaccaagctgaccgtctaagtcagcccaaggctgccccctggtcactctgtt

SEQ ID NO: 553365 - DNA, 515 bp, Homo sapiens
  misc_feature: HIJSMM301EFTP0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacggaccgaacggtaggaagtacaaacgaactacgtggcgtgcaccatctgtcttctactcttcccgtccact

SEQ ID NO: 553366 - DNA, 490 bp, Homo sapiens
  misc_feature: HIJSMM301EKQSS.48.65.F10.1.454.light.4.raw
agtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtctaggtcagcccaaggctcg

SEQ ID NO: 553367 - DNA, 515 bp, Homo sapiens
  misc_feature: HIJSMM301AWVPE.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctgccccctcggtcactctgttcccaccctcct

SEQ ID NO: 553368 - DNA, 479 bp, Homo sapiens
  misc_feature: HIJSMM301AUYJ9.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcggggggaccaaggtggagatcaaacgaactgtggctgcacc

SEQ ID NO: 553369 - DNA, 494 bp, Homo sapiens; identical to SEQ ID NO: 535276
  misc_feature: HIJSMM301DD676.16.6.A06.1.454.light.4.raw

SEQ ID NO: 553370 - DNA, 495 bp, Homo sapiens; identical to SEQ ID NO: 536316
  misc_feature: HIJSMM301AI97B.40.23.C01.1.454.light.4.raw

SEQ ID NO: 553371 - DNA, 512 bp, Homo sapiens; identical to SEQ ID NO: 552719
  misc_feature: HIJSMM301C1R8Z.22.36.D03.1.454.light.4.raw

SEQ ID NO: 553372 - DNA, 473 bp, Homo sapiens
  misc_feature: HIJSMM301AYDRD.49.32.C10.1.454.light.4.raw
agtcgagagacacgaccggtgctcgatttagtatagacatcaacacacaaaggggcagtcccaaccaggacacagcatggacatgagggtccctgctcagctcctggggctcctgctgctctggctctcaggtgccagatgtatcatccagatgacccagtctccatcctccgtgtctgcatttataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataaatcttccgctcacttttcggcggagggaccaaggtggggatcagacgaactgt

SEQ ID NO: 553373 - DNA, 492 bp, Homo sapiens; identical to SEQ ID NO: 536175
  misc_feature: HIJSMM301CRZZ0.19.83.H06.1.454.light.4.raw

SEQ ID NO: 553374 - DNA, 496 bp, Homo sapiens
  misc_feature: HIJSMM301CIKJE.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaaatcaaacgaactgtggctgcacc

SEQ ID NO: 553375 - DNA, 486 bp, Homo sapiens; identical to SEQ ID NO: 535043
  misc_feature: HIJSMM301DA2MA.46.35.D02.1.454.light.4.raw

SEQ ID NO: 553376 - DNA, 494 bp, Homo sapiens; identical to SEQ ID NO: 549057
  misc_feature: HIJSMM301D6YOU.10.33.C11.1.454.light.4.raw

SEQ ID NO: 553377 - DNA, 503 bp, Homo sapiens; identical to SEQ ID NO: 541454
  misc_feature: HIJSMM301CL3LA.9.12.B01.1.454.light.4.raw

SEQ ID NO: 553378 - DNA, 496 bp, Homo sapiens
  misc_feature: HIJSMM301DZD2O.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccgaggtaggaatagaaaggaactgtggctgcaccatctgtctt

SEQ ID NO: 553379 - DNA, 498 bp, Homo sapiens
  misc_feature: HIJSMM301BH1VT.15.26.C04.1.454.light.4.raw
  modified_base (496)..(496): a, c, t, g, unknown or other
tctacgtagccacgaccggtgctcgatttagtctagcgactttgggtttggggtcagactcagtcaggacacagcatggacatgagggtccccgctcagctcctggggctcctgctgctctggctcccaggtgcccaatgtggacatccaaggatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcntt

SEQ ID NO: 553380 - DNA, 492 bp, Homo sapiens
  misc_feature: HIJSMM301EUVVB.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctactttcggcggagggaccgaaggcggagagtcagacgaactgtggctgcaccatctgtcttcta

SEQ ID NO: 553381 - DNA, 486 bp, Homo sapiens; identical to SEQ ID NO: 535043
  misc_feature: HIJSMM301D0RBE.46.35.D02.1.454.light.4.raw

SEQ ID NO: 553382 - DNA, 496 bp, Homo sapiens
  misc_feature: HIJSMM301BWCQH.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 553383 - DNA, 500 bp, Homo sapiens
  misc_feature: HIJSMM301DMH0I.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtgagatcaaacgaactgtggctgcaccatctgtctt

SEQ ID NO: 553384 - DNA, 481 bp, Homo sapiens
  misc_feature: HIJSMM301BIPCA.5.34.D01.1.454.light.4.raw
atcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaaaatactaacagtctcccgcgcagttttggccagggaccaaagtggagatcaaacgaactgtggctgca

SEQ ID NO: 553385 - DNA, 484 bp, Homo sapiens; identical to SEQ ID NO: 544622
  misc_feature: HIJSMM301BI11N.15.28.C06.1.454.light.4.raw

SEQ ID NO: 553386 - DNA, 487 bp, Homo sapiens; identical to SEQ ID NO: 536206
  misc_feature: HIJSMM301CDXJ1.47.38.D05.1.454.light.4.raw

SEQ ID NO: 553387 - DNA, 476 bp, Homo sapiens
  misc_feature: HIJSMM301AW8BB.5.12.B01.1.454.light.4.raw
atcagacacgcacgaccggtgctcgatttagtagtgtagattccgcgggggggtcgtcaggaggcagcgctctcgggacgtctccaccatggcctgggcgtctgctattcctcaccctcctcactcagggcacagggtcctgggcccgagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 553388 - DNA, 503 bp, Homo sapiens; identical to SEQ ID NO: 546983
  misc_feature: HIJSMM301AFCAX.21.22.B11.1.454.light.4.raw

SEQ ID NO: 553389 - DNA, 496 bp, Homo sapiens; identical to SEQ ID NO: 536248
  misc_feature: HIJSMM301EMDUT.22.27.C05.1.454.light.4.raw

SEQ ID NO: 553390 - DNA, 476 bp, Homo sapiens
  misc_feature: HIJSMM301B5GQT.12.1.A01.1.454.light.4.raw
atacgacgtacacgaccggtgctcgatttagacgtctcatcagggcacagcatggacatgagggtccccgctcagctcctgggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccta

SEQ ID NO: 553391 - DNA, 498 bp, Homo sapiens
  misc_feature: HIJSMM301C3YDU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtagggatatcagacggaaactgtggctg

SEQ ID NO: 553392 - DNA, 509 bp, Homo sapiens; identical to SEQ ID NO: 539359
  misc_feature: HIJSMM301BPKD5.47.85.H08.1.454.light.4.raw

SEQ ID NO: 553393 - DNA, 515 bp, Homo sapiens; identical to SEQ ID NO: 551931
  misc_feature: HIJSMM301DSJHQ.8.43.D10.1.454.light.4.raw

SEQ ID NO: 553394 - DNA, 460 bp, Homo sapiens; identical to SEQ ID NO: 536053
  misc_feature: HIJSMM301AFLYJ.22.28.C06.1.454.light.4.raw

SEQ ID NO: 553395 - DNA, 488 bp, Homo sapiens; identical to SEQ ID NO: 537260
  misc_feature: HIJSMM301C8862.47.70.G04.1.454.light.4.raw

SEQ ID NO: 553396 - DNA, 488 bp, Homo sapiens
  misc_feature: HIJSMM301EQ238.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcacgatctgtcttca

SEQ ID NO: 553397 - DNA, 504 bp, Homo sapiens
  misc_feature: HIJSMM301ELI9U.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaaactgaccgtcctaggtcagcccaaggctgccccctcggtcactctgtt

SEQ ID NO: 553398 - DNA, 505 bp, Homo sapiens
  misc_feature: HIJSMM301BOH46.48.70.G04.1.454.light.4.raw
agtatacatacacgaccggtgctcgatttagtgtagtgtgaagggaaaggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcgccggggaccgaacgtggaaatacaaacgaactagtggctgcaccactctgtctt

SEQ ID NO: 553399 - DNA, 514 bp, Homo sapiens
  misc_feature: HIJSMM301BO8Z3.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggaggaccaagctgaccgtcctaggtcagcccaaggctgccccctcggtcactctgttcccaccctcct

SEQ ID NO: 553400 - DNA, 482 bp, Homo sapiens
  misc_feature: HIJSMM301AWAJY.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccatcaaggttcagcggcggtggatctgggacagaattcactctcaccatcagcagcctacagcctgatgattttgcgacttattattgccaacagtataagagttattcaactttcggccctgggaccaatgtggatatcaacgaactgtggctgcaccatctgtctt

SEQ ID NO: 553401 - DNA, 495 bp, Homo sapiens
  misc_feature: HIJSMM301EHYPH.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacactttggccaggggaccaagctggagatcaaacgaactgtggctgcaccatctgtcttc

SEQ ID NO: 553402 - DNA, 446 bp, Homo sapiens
  misc_feature: HIJSMM301B09TI.18.9.A09.1.454.light.4.raw
  modified_base (428)..(428): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgtcccnccctcctccatactcgta

SEQ ID NO: 553403 - DNA, 485 bp, Homo sapiens; identical to SEQ ID NO: 542514
  misc_feature: HIJSMM301BL05P.48.22.B11.1.454.light.4.raw

SEQ ID NO: 553404 - DNA, 383 bp, Homo sapiens; identical to SEQ ID NO: 447524
  misc_feature: HIJSMM301DVSTO.41.26.C04.1.454.light.4.raw

SEQ ID NO: 553405 - DNA, 493 bp, Homo sapiens; identical to SEQ ID NO: 540127
  misc_feature: HIJSMM301BLFPZ.10.17.B06.1.454.light.4.raw

SEQ ID NO: 553406 - DNA, 377 bp, Homo sapiens; identical to SEQ ID NO: 536071
  misc_feature: HIJSMM301B4Y6D.40.9.A09.1.454.light.4.raw

SEQ ID NO: 553407 - DNA, 494 bp, Homo sapiens
  misc_feature: HIJSMM301AFFY1.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactagttagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 553408 - DNA, 354 bp, Homo sapiens; identical to SEQ ID NO: 535026
  misc_feature: HIJSMM301D7EL2.19.22.B11.1.454.light.4.raw

SEQ ID NO: 553409 - DNA, 503 bp, Homo sapiens
  misc_feature: HIJSMM301CP621.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaactccactgtcact

SEQ ID NO: 553410 - DNA, 513 bp, Homo sapiens; identical to SEQ ID NO: 535244
  misc_feature: HIJSMM301A4W02.17.33.C11.1.454.light.4.raw

SEQ ID NO: 553411 - DNA, 485 bp, Homo sapiens; identical to SEQ ID NO: 542735
  misc_feature: HIJSMM301CTHR5.26.45.E01.1.454.light.4.raw

SEQ ID NO: 553412 - DNA, 517 bp, Homo sapiens; identical to SEQ ID NO: 537838
  misc_feature: HIJSMM301BHXTM.7.86.H09.1.454.light.4.raw

SEQ ID NO: 553413 - DNA, 503 bp, Homo sapiens; identical to SEQ ID NO: 547049
  misc_feature: HIJSMM301EHW59.18.59.F04.1.454.light.4.raw

SEQ ID NO: 553414 - DNA, 500 bp, Homo sapiens
  misc_feature: HIJSMM301D2DH5.51.88.H11.1.454.light.4.raw
cgatcgtatacacgaccggtgctcgatttagcgacagcgagaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccacgggtggaaatacaagacgaactgtggctgcaccatctgtcttcta

SEQ ID NO: 553415 - DNA, 489 bp, Homo sapiens; identical to SEQ ID NO: 535091
  misc_feature: HIJSMM301D83NU.47.36.D03.1.454.light.4.raw

SEQ ID NO: 553416 - DNA, 504 bp, Homo sapiens; identical to SEQ ID NO: 550151
  misc_feature: HIJSMM301BGZBT.2.21.B10.1.454.light.4.raw

SEQ ID NO: 553417 - DNA, 486 bp, Homo sapiens; identical to SEQ ID NO: 535917
  misc_feature: HIJSMM301DFAZE.3.10.A10.1.454.light.4.raw

SEQ ID NO: 553418 - DNA, 494 bp, Homo sapiens; identical to SEQ ID NO: 535629
  misc_feature: HIJSMM301DIENR.4.27.C05.1.454.light.4.raw

SEQ ID NO: 553419 - DNA, 496 bp, Homo sapiens; identical to SEQ ID NO: 535109
  misc_feature: HIJSMM301ALZTV.16.78.H01.1.454.light.4.raw

SEQ ID NO: 553420 - DNA, 508 bp, Homo sapiens
  misc_feature: HIJSMM301DCA0T.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtgcgcgtgggtgttcggcggaggaccaagctgaccgtcctgggtcagcccaaggctgccccctggtcactctgttcccaccctcc

SEQ ID NO: 553421 - DNA, 496 bp, Homo sapiens
  misc_feature: HIJSMM301ADJKS.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaacgaactgtggctgcaccatctgtcttcatcttcccgccat

SEQ ID NO: 553422 - DNA, 518 bp, Homo sapiens; identical to SEQ ID NO: 539372
  misc_feature: HIJSMM301ADBGT.7.86.H09.1.454.light.4.raw

SEQ ID NO: 553423 - DNA, 505 bp, Homo sapiens; identical to SEQ ID NO: 535503
  misc_feature: HIJSMM301CMAAX.8.28.C06.1.454.light.4.raw

SEQ ID NO: 553424 - DNA, 493 bp, Homo sapiens
  misc_feature: HIJSMM301C3TJE.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggcaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcta

SEQ ID NO: 553425 - DNA, 444 bp, Homo sapiens; identical to SEQ ID NO: 535027
  misc_feature: HIJSMM301BL0VR.8.73.G07.1.454.light.4.raw

SEQ ID NO: 553426 - DNA, 492 bp, Homo sapiens; identical to SEQ ID NO: 534967
  misc_feature: HIJSMM301CLOLG.47.64.F09.1.454.light.4.raw

SEQ ID NO: 553427 - DNA, 526 bp, Homo sapiens
  misc_feature: HIJSMM301D95VC.43.35.D02.1.454.light.4.raw
tgtgagtagtcacgaccggtgctcgatttagcacacgatagttgggtttgggggctctgcttcagctgtgagcgcagaaggcaggactcgggacaatcttcatcatgacctgctcccctctcctcctcacccttctcattcactgcacagggtcctgggcccagtctgtcttgacgcagccgccctcagtgtctgcggccccaggacagaaggtcaccatctcctgcactggaagtacgtccaacattgggaatttttatgtatcctggtaccaacaagtcccaggaacagcccccaaactcctcgtttatcacaatagtcagcgaccgtcagggattcctgaccgattttctggctccaagtctggcacgtcagccaccctggtcatcaccggactccagactggggacgaggccgattattactgcggaacatgggataccagtccggagggttgggtgttcggcggagggaccaagttgaccgtcctaggtcagcccaaggctgccccctcggtcactctgtt

SEQ ID NO: 553428 - DNA, 481 bp, Homo sapiens; identical to SEQ ID NO: 537819
  misc_feature: HIJSMM301B26NY.22.59.F04.1.454.light.4.raw

SEQ ID NO: 553429 - DNA, 496 bp, Homo sapiens; identical to SEQ ID NO: 553139
  misc_feature: HIJSMM301D62WZ.3.33.C11.1.454.light.4.raw
  modified_base (478)..(478): a, c, t, g, unknown or other

SEQ ID NO: 553430 - DNA, 489 bp, Homo sapiens
  misc_feature: HIJSMM301C6DHU.14.55.E11.1.454.light.4.raw
cgtctagtaccacgaccggtgctcgatttagcactcgcacgttgggtttggggagtctcagccaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 553431 - DNA, 495 bp, Homo sapiens; identical to SEQ ID NO: 546327
  misc_feature: HIJSMM301CFU9D.7.59.F04.1.454.light.4.raw

SEQ ID NO: 553432 - DNA, 507 bp, Homo sapiens; identical to SEQ ID NO: 535641
  misc_feature: HIJSMM301BXY17.10.88.H11.1.454.light.4.raw

SEQ ID NO: 553433 - DNA, 485 bp, Homo sapiens
  misc_feature: HIJSMM301AF9C6.40.83.H06.1.454.light.4.raw
tctagcgactcacgaccggtgctcgatttagatcacgtgcgtcgcggggaaacagagcttcagcaagcatagtgggaatctgcaccatgccctcgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaa

SEQ ID NO: 553434 - DNA, 422 bp, Homo sapiens; identical to SEQ ID NO: 539229
  misc_feature: HIJSMM301D4ZIS.41.15.B04.1.454.light.4.raw

SEQ ID NO: 553435 - DNA, 484 bp, Homo sapiens; identical to SEQ ID NO: 535400
  misc_feature: HIJSMM301B1IH5.46.26.C04.1.454.light.4.raw

SEQ ID NO: 553436 - DNA, 504 bp, Homo sapiens
  misc_feature: HIJSMM301CCDTL.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcaccttcggtcgggggcggaacggtaggaggagtacaacaaactacgtgtggtgcgaccactctcgtt

SEQ ID NO: 553437 - DNA, 506 bp, Homo sapiens
  misc_feature: HIJSMM301CP365.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatcggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcgggcggagggaccaaggtggccgtcctaggtcagcccaaggctgccccctcggtcact

SEQ ID NO: 553438 - DNA, 496 bp, Homo sapiens
  misc_feature: HIJSMM301EMW8P.48.53.E09.1.454.light.4.raw
agtatacatacacgaccggtgctcgatttagagagagtgtgttgggtttgggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatctacggtgcatccagcagggccattggcatcccagacaggttcagtggcagtgggtctgggacaaacttcactctcaccatcagcagactggagcctgaagattttgcagtctattactgtcagcagtatactaactcacctaagacgttcggccaagggaccaaggtggaaatcaaacgaactgtggctgcaccatctgtcttcatcttcccgccatctgatatgtatact

SEQ ID NO: 553439 - DNA, 447 bp, Homo sapiens; identical to SEQ ID NO: 535882
  misc_feature: HIJSMM301D32S4.18.9.A09.1.454.light.4.raw
  modified_base (429)..(429): a, c, t, g, unknown or other

SEQ ID NO: 553440 - DNA, 513 bp, Homo sapiens; identical to SEQ ID NO: 535244
  misc_feature: HIJSMM301DRZ71.17.33.C11.1.454.light.4.raw

SEQ ID NO: 553441 - DNA, 488 bp, Homo sapiens; identical to SEQ ID NO: 542699
  misc_feature: HIJSMM301BADWH.12.51.E07.1.454.light.4.raw

SEQ ID NO: 553442 - DNA, 509 bp, Homo sapiens; identical to SEQ ID NO: 542468
  misc_feature: HIJSMM301ANI5B.8.33.C11.1.454.light.4.raw

SEQ ID NO: 553443 - DNA, 489 bp, Homo sapiens; identical to SEQ ID NO: 535139
  misc_feature: HIJSMM301B1IEU.14.55.E11.1.454.light.4.raw

SEQ ID NO: 553444 - DNA, 499 bp, Homo sapiens
  misc_feature: HIJSMM301DMWQ6.43.35.D02.1.454.light.4.raw
  modified_base (203)..(203): a, c, t, g, unknown or other
  modified_base (457)..(457): a, c, t, g, unknown or other
tgtgagtagtcacgaccggtgctcgatttagcacacgatagttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccgganagagggtcagtcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggngttcggcggagggaccaaggtgaccgtcctaggtcagccccg

SEQ ID NO: 553445 - DNA, 502 bp, Homo sapiens; identical to SEQ ID NO: 541971
  misc_feature: HIJSMM301A8FZG.4.39.D06.1.454.light.4.raw

SEQ ID NO: 553446 - DNA, 494 bp, Homo sapiens; identical to SEQ ID NO: 534994
  misc_feature: HIJSMM301CFVSE.27.78.H01.1.454.light.4.raw

SEQ ID NO: 553447 - DNA, 440 bp, Homo sapiens
  misc_feature: HIJSMM301A8HXP.4.22.B11.1.454.light.4.raw
agcactgtagcacgaccggtgctcgatttagacgacagctcaggggtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtccgagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccatctgtcttcatcttcccgccatctgactacagtgct

SEQ ID NO: 553448 - DNA, 497 bp, Homo sapiens
  misc_feature: HIJSMM301AHDWI.14.53.E09.1.454.light.4.raw
  modified_base (482)..(482): a, c, t, g, unknown or other
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggttaccagcagaagccaggccaggcccctcctcttgattatatataaggacactgagaggccctccagggatccctcgagcgattctctggctccagctcagggacaacactcaccttgaccatcagtgcagtccaggcagaagacgaggctgactattaattgtcaatcagcagtcagcacctaaattcttatcgggtggttcggtcggagggaccaatctgaccgtcctaggtcagcccaaggcgtnccccctccggtcgta

SEQ ID NO: 553449 - DNA, 451 bp, Homo sapiens
  misc_feature: HIJSMM301C2CXW.9.9.A09.1.454.light.4.raw
tgatacgtctcacgaccggtgctcgatttagcgagacgcgcaggggtcctgggcccagtctgtgctgacgcagccgccctcagtgtctgggggcccccagggcagagggtcaccgatctcctgcactgggagcagctccaacatcgggaatcgctatgttgtacactggtaccagcagcttccaggaacagtccccaaaccctcatctatggtaatagtaatcggcccttcagggggtccctgaccgattctctggctccaagtctggcacctcagcctccctaggccatcacctgggcttcaggctgaggatgaggctgattattactgccactcctatgacagcagcctgagaagtgtggtattcggcggagggaccaagctgaccgtcctaggtcagcccaaggctgccccctggtcactctgttcccgccctcctcagacgtatcca

SEQ ID NO: 553450 - DNA, 496 bp, Homo sapiens; identical to SEQ ID NO: 536690
  misc_feature: HIJSMM301D3BJD.40.23.C01.1.454.light.4.raw

SEQ ID NO: 553451 - DNA, 521 bp, Homo sapiens
  misc_feature: HIJSMM301DIQLP.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggccctccctgaccatctccgggctccagcctgaggacgaggctgattattattgtagttcatatacaaccagtgacacttgggtgttcggcggagggaccaggctgaccgtcctaggtcagccaaggctcgccccctcggtcactctcgtcccaccct

SEQ ID NO: 553452 - DNA, 506 bp, Homo sapiens
  misc_feature: HIJSMM301C09MN.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccagaccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactgtggctgcaccatctgt

SEQ ID NO: 553453 - DNA, 478 bp, Homo sapiens; identical to SEQ ID NO: 535129
  misc_feature: HIJSMM301DKEQG.11.11.A11.1.454.light.4.raw

SEQ ID NO: 553454 - DNA, 507 bp, Homo sapiens
  misc_feature: HIJSMM301DXLZ3.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccatggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggaggggaccaaagggtggaggatcaaacggaactagtggctgcaccat

SEQ ID NO: 553455 - DNA, 494 bp, Homo sapiens; identical to SEQ ID NO: 534994
  misc_feature: HIJSMM301AQ3RX.27.78.H01.1.454.light.4.raw

SEQ ID NO: 553456 - DNA, 514 bp, Homo sapiens; identical to SEQ ID NO: 546238
  misc_feature: HIJSMM301BYO2D.47.85.H08.1.454.light.4.raw

SEQ ID NO: 553457 - DNA, 505 bp, Homo sapiens
  misc_feature: HIJSMM301EZIJB.41.33.C11.1.454.light.4.raw
tctatactatcacgaccggtgctcgatttagagtgagctcgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccta

SEQ ID NO: 553458 - DNA, 441 bp, Homo sapiens; identical to SEQ ID NO: 535074
  misc_feature: HIJSMM301EK3IM.11.3.A03.1.454.light.4.raw

SEQ ID NO: 553459 - DNA, 520 bp, Homo sapiens; identical to SEQ ID NO: 535686
  misc_feature: HIJSMM301AJD2E.41.19.B08.1.454.light.4.raw

SEQ ID NO: 553460 - DNA, 493 bp, Homo sapiens
  misc_feature: HIJSMM301B6SZN.47.78.H01.1.454.light.4.raw
agctcacgtacacgaccggtgctcgatttagtgtgagtagtttgggtttgggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggccccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtctt

SEQ ID NO: 553461 - DNA, 511 bp, Homo sapiens; identical to SEQ ID NO: 541549
  misc_feature: HIJSMM301EUL2V.40.33.C11.1.454.light.4.raw

SEQ ID NO: 553462 - DNA, 509 bp, Homo sapiens; identical to SEQ ID NO: 537131
  misc_feature: HIJSMM301DYGFK.17.33.C11.1.454.light.4.raw

SEQ ID NO: 553463 - DNA, 494 bp, Homo sapiens
  misc_feature: HIJSMM301CENYB.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcgccaaggacacgactggagattaaacgaactagtggctgcaccatctgtcttcatt

SEQ ID NO: 553464 - DNA, 503 bp, Homo sapiens; identical to SEQ ID NO: 537189
  misc_feature: HIJSMM301AO9X8.19.85.H08.1.454.light.4.raw

SEQ ID NO: 553465 - DNA, 493 bp, Homo sapiens
  misc_feature: HIJSMM301ERK77.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactggaccacggtcacgtcct

SEQ ID NO: 553466 - DNA, 495 bp, Homo sapiens; identical to SEQ ID NO: 536931
  misc_feature: HIJSMM301ELLUH.10.33.C11.1.454.light.4.raw

SEQ ID NO: 553467 - DNA, 494 bp, Homo sapiens
  misc_feature: HIJSMM301A0QUM.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 553468 - DNA, 503 bp, Homo sapiens; identical to SEQ ID NO: 538973
  misc_feature: HIJSMM301A3JGA.5.86.H09.1.454.light.4.raw

SEQ ID NO: 553469 - DNA, 511 bp, Homo sapiens; identical to SEQ ID NO: 541720
  misc_feature: HIJSMM301DT50A.5.58.F03.1.454.light.4.raw

SEQ ID NO: 553470 - DNA, 486 bp, Homo sapiens
  misc_feature: HIJSMM301DZQNO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtacactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 553471 - DNA, 463 bp, Homo sapiens
  misc_feature: HIJSMM301CWMN4.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctctccatactcgta

SEQ ID NO: 553472 - DNA, 492 bp, Homo sapiens; identical to SEQ ID NO: 537246
  misc_feature: HIJSMM301APOTP.43.28.C06.1.454.light.4.raw

SEQ ID NO: 553473 - DNA, 447 bp, Homo sapiens; identical to SEQ ID NO: 549542
  misc_feature: HIJSMM301C5899.18.9.A09.1.454.light.4.raw

SEQ ID NO: 553474 - DNA, 483 bp, Homo sapiens
  misc_feature: HIJSMM301BMSL3.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgcttcactttcggcggagggaccaaggtggaggtcaagcgaactgtggctgcacc

SEQ ID NO: 553475 - DNA, 517 bp, Homo sapiens; identical to SEQ ID NO: 536262
  misc_feature: HIJSMM301ATTNJ.14.70.G04.1.454.light.4.raw

SEQ ID NO: 553476 - DNA, 494 bp, Homo sapiens
  misc_feature: HIJSMM301DE3PG.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggt

SEQ ID NO: 553477 - DNA, 471 bp, Homo sapiens
  misc_feature: HIJSMM301AZC3M.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaaggtggaggatcaagcgaa

SEQ ID NO: 553478 - DNA, 470 bp, Homo sapiens
  misc_feature: HIJSMM301AI368.43.60.F05.1.454.light.4.raw
  modified_base (443)..(443): a, c, t, g, unknown or other
tgtgagtagtcacgaccggtgctcgatttagtacgtcatcagggaaagagggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccccggacgtcgtcncggacgacggtggagtgtcagacgaac

SEQ ID NO: 553479 - DNA, 494 bp, Homo sapiens; identical to SEQ ID NO: 535276
  misc_feature: HIJSMM301B2JCF.16.6.A06.1.454.light.4.raw

SEQ ID NO: 553480 - DNA, 480 bp, Homo sapiens
  misc_feature: HIJSMM301A39NG.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggacc

SEQ ID NO: 553481 - DNA, 489 bp, Homo sapiens
  misc_feature: HIJSMM301C2Y2Y.13.42.D09.1.454.light.4.raw
  modified_base (460)..(460): a, c, t, g, unknown or other
  modified_base (481)..(481): a, c, t, g, unknown or other
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttgccaggacgaagtaggaaganaacgaaactagtaggcgtcgnaccactct

SEQ ID NO: 553482 - DNA, 501 bp, Homo sapiens
  misc_feature: HIJSMM301ET7TM.48.58.F03.1.454.light.4.raw
agtatacatacacgaccggtgctcgatttagtctgatcgagaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttccccg

SEQ ID NO: 553483 - DNA, 488 bp, Homo sapiens; identical to SEQ ID NO: 535081
  misc_feature: HIJSMM301DCVGQ.26.23.C01.1.454.light.4.raw

SEQ ID NO: 553484 - DNA, 510 bp, Homo sapiens
  misc_feature: HIJSMM301C4611.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggccctcgggaccaaggtggagatcaaacgaactgtggctgcaccatctgtcttcta

SEQ ID NO: 553485 - DNA, 447 bp, Homo sapiens; identical to SEQ ID NO: 535020
  misc_feature: HIJSMM301C1WKU.18.9.A09.1.454.light.4.raw

SEQ ID NO: 553486 - DNA, 497 bp, Homo sapiens
  misc_feature: HIJSMM301E08DI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagaattaaaggaactagtggctgcaccatctgtcttcatcttccccg

SEQ ID NO: 553487 - DNA, 447 bp, Homo sapiens; identical to SEQ ID NO: 535201
  misc_feature: HIJSMM301COVNR.18.9.A09.1.454.light.4.raw

SEQ ID NO: 553488 - DNA, 489 bp, Homo sapiens; identical to SEQ ID NO: 535139
  misc_feature: HIJSMM301DT68J.14.55.E11.1.454.light.4.raw

SEQ ID NO: 553489 - DNA, 447 bp, Homo sapiens; identical to SEQ ID NO: 535020
  misc_feature: HIJSMM301CCWHY.18.9.A09.1.454.light.4.raw

SEQ ID NO: 553490 - DNA, 485 bp, Homo sapiens
  misc_feature: HIJSMM301B3XKJ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgagattttgcagtctattactgtcagcagtatggtcacgtcccaagaacttttggccaggggaccaagctggagatcaaacgaactgtggctgcaccat

SEQ ID NO: 553491 - DNA, 487 bp, Homo sapiens
  misc_feature: HIJSMM301AZPUC.4.27.C05.1.454.light.4.raw
agcactgtagcacgaccggtgctcgatttagacgcgatcgaagggtttggggtgactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaa

SEQ ID NO: 553492 - DNA, 493 bp, Homo sapiens; identical to SEQ ID NO: 535084
  misc_feature: HIJSMM301AZ47E.47.64.F09.1.454.light.4.raw

SEQ ID NO: 553493 - DNA, 462 bp, Homo sapiens
  misc_feature: HIJSMM301D04MV.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctctcaatttcggccctgggaccagagtggacatgaaacgaa

SEQ ID NO: 553494 - DNA, 488 bp, Homo sapiens
  misc_feature: HIJSMM301EDSJO.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatcctctgggctccaggctgacgacgaggctaattattactgctgctcatatgaaggttataacactatactattcggcggagggaccaagctcgaccgtcctgcgtcacgcccaaggctcgcccctcgtcactctcgttcccgccctcctcgctacgtaga

SEQ ID NO: 553495 - DNA, 509 bp, Homo sapiens
  misc_feature: HIJSMM301EAFIJ.40.67.G01.1.454.light.4.raw
tctagcgactcacgaccggtgctcgatttagagtatacatattgggtttggggagagccctggggaggaactgctcagttaggacccagagggaaccatgggagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctgggagcccgaagattttgcggtttattactgtcagcagcgtgccgactggcccctcacgttcggcggagggaccaaggtggacatcaaacgaactgtggctgcaccatctgtcttcatt

SEQ ID NO: 553496 - DNA, 499 bp, Homo sapiens; identical to SEQ ID NO: 541101
  misc_feature: HIJSMM301AMBE3.43.34.D01.1.454.light.4.raw

SEQ ID NO: 553497 - DNA, 478 bp, Homo sapiens; identical to SEQ ID NO: 535449
  misc_feature: HIJSMM301DTJ2P.40.59.F04.1.454.light.4.raw

SEQ ID NO: 553498 - DNA, 497 bp, Homo sapiens; identical to SEQ ID NO: 539058
  misc_feature: HIJSMM301AE5SI.12.87.H10.1.454.light.4.raw

SEQ ID NO: 553499 - DNA, 467 bp, Homo sapiens; identical to SEQ ID NO: 535997
  misc_feature: HIJSMM301DJ14W.5.36.D03.1.454.light.4.raw

SEQ ID NO: 553500 - DNA, 493 bp, Homo sapiens
  misc_feature: HIJSMM301B9LI6.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 553501 - DNA, 492 bp, Homo sapiens; identical to SEQ ID NO: 536175
  misc_feature: HIJSMM301D0J6D.19.83.H06.1.454.light.4.raw

SEQ ID NO: 553502 - DNA, 494 bp, Homo sapiens; identical to SEQ ID NO: 534992
  misc_feature: HIJSMM301B1EMB.9.1.A01.1.454.light.4.raw

SEQ ID NO: 553503 - DNA, 493 bp, Homo sapiens
  misc_feature: HIJSMM301EHUUC.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttggcacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatt

SEQ ID NO: 553504 - DNA, 509 bp, Homo sapiens
  misc_feature: HIJSMM301ECQAT.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgtcctttatgtggggcgtggcatttgggtgttcggcggagggaccaaactgaccgtcctaggtcagcccaaggctgccccctcggtcact

SEQ ID NO: 553505 - DNA, 509 bp, Homo sapiens; identical to SEQ ID NO: 543266
  misc_feature: HIJSMM301ET44W.17.33.C11.1.454.light.4.raw

SEQ ID NO: 553506 - DNA, 512 bp, Homo sapiens; identical to SEQ ID NO: 542788
  misc_feature: HIJSMM301BIEVD.17.33.C11.1.454.light.4.raw

SEQ ID NO: 553507 - DNA, 444 bp, Homo sapiens; identical to SEQ ID NO: 535192
  misc_feature: HIJSMM301EREAO.5.9.A09.1.454.light.4.raw

SEQ ID NO: 553508 - DNA, 494 bp, Homo sapiens
  misc_feature: HIJSMM301B70HT.49.66.F11.1.454.light.4.raw
agtcgagagacacgaccggtgctcgatttagtcacgcgagaagagggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtatcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 553509 - DNA, 447 bp, Homo sapiens; identical to SEQ ID NO: 535020
  misc_feature: HIJSMM301DX214.18.9.A09.1.454.light.4.raw

SEQ ID NO: 553510 - DNA, 505 bp, Homo sapiens
  misc_feature: HIJSMM301AHS9U.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggacttcggccaagggaccaaggtggaattcaaccgaactgtggctgcaccatctgtcttcatcttcccg

SEQ ID NO: 553511 - DNA, 503 bp, Homo sapiens
  misc_feature: HIJSMM301DD2QS.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatcttcccg

SEQ ID NO: 553512 - DNA, 484 bp, Homo sapiens; identical to SEQ ID NO: 535400
  misc_feature: HIJSMM301AF1K8.46.26.C04.1.454.light.4.raw

SEQ ID NO: 553513 - DNA, 479 bp, Homo sapiens
  misc_feature: HIJSMM301BKSA2.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctggctccaggctgacgatgaggctgattattattgccagtcctatgacaacaccctgcgtggttttggctgttcgcggcgggacc

SEQ ID NO: 553514 - DNA, 487 bp, Homo sapiens; identical to SEQ ID NO: 541729
  misc_feature: HIJSMM301CJA26.40.83.H06.1.454.light.4.raw

SEQ ID NO: 553515 - DNA, 505 bp, Homo sapiens; identical to SEQ ID NO: 536254
  misc_feature: HIJSMM301B0C1S.7.71.G05.1.454.light.4.raw

SEQ ID NO: 553516 - DNA, 485 bp, Homo sapiens
  misc_feature: HIJSMM301BQO1R.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttggggtgtttggcggagggaccaagctgaccgtccct

SEQ ID NO: 553517 - DNA, 493 bp, Homo sapiens; identical to SEQ ID NO: 537239
  misc_feature: HIJSMM301BBEK8.49.66.F11.1.454.light.4.raw

SEQ ID NO: 553518 - DNA, 495 bp, Homo sapiens; identical to SEQ ID NO: 535712
  misc_feature: HIJSMM301AIVF8.27.78.H01.1.454.light.4.raw

SEQ ID NO: 553519 - DNA, 489 bp, Homo sapiens; identical to SEQ ID NO: 535386
  misc_feature: HIJSMM301C18M5.12.51.E07.1.454.light.4.raw

SEQ ID NO: 553520 - DNA, 484 bp, Homo sapiens
  misc_feature: HIJSMM301EB8T7.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaaggtggaatacaaacgaactgtggctgcaccta

SEQ ID NO: 553521 - DNA, 498 bp, Homo sapiens
  misc_feature: HIJSMM301DYYPV.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactatattgtcaagcagtagacagcagtggtccttatcgggtgttcggcgggggaccaagctgaccgtcctaggtcagccaaggctgccccctcggtcactctcg

SEQ ID NO: 553522 - DNA, 510 bp, Homo sapiens; identical to SEQ ID NO: 535474
  misc_feature: HIJSMM301D8XVE.17.33.C11.1.454.light.4.raw

SEQ ID NO: 553523 - DNA, 494 bp, Homo sapiens; identical to SEQ ID NO: 534992
  misc_feature: HIJSMM301D2AJA.9.1.A01.1.454.light.4.raw

SEQ ID NO: 553524 - DNA, 496 bp, Homo sapiens
  misc_feature: HIJSMM301DPKH5.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccc

SEQ ID NO: 553525 - DNA, 471 bp, Homo sapiens
  misc_feature: HIJSMM301BQ3OP.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctccgagtgccacttttggcgggggtaccaaggtggacatcaaacgaa

SEQ ID NO: 553526 - DNA, 486 bp, Homo sapiens
  misc_feature: HIJSMM301CYDD1.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagatttgcaattattactgtcagcagtataataactggtggacgttcggccaagggaccaaggtagaaatcaaacgaactagtggctgcaccatctgt

SEQ ID NO: 553527 - DNA, 498 bp, Homo sapiens
  misc_feature: HIJSMM301BII0T.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggtcggaggggaccgaaggtaggaggatacaaacgaaa

SEQ ID NO: 553528 - DNA, 415 bp, Homo sapiens
  misc_feature: HIJSMM301A2VLL.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcggtagtaca

SEQ ID NO: 553529 - DNA, 504 bp, Homo sapiens
  misc_feature: HIJSMM301BT7V9.51.83.H06.1.454.light.4.raw
  modified_base (454)..(454): a, c, t, g, unknown or other
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttatattgtcagcagcgaaacaactggcctcgtgtcgtcgacgacggacgaggagaanacaacgtactggtcgtcgtgaccactactcgtcgttcttctacttccccg

SEQ ID NO: 553530 - DNA, 501 bp, Homo sapiens; identical to SEQ ID NO: 535746
  misc_feature: HIJSMM301BJDQO.18.11.A11.1.454.light.4.raw

SEQ ID NO: 553531 - DNA, 499 bp, Homo sapiens
  misc_feature: HIJSMM301CDZ7C.43.49.E05.1.454.light.4.raw
  modified_base (485)..(485): a, c, t, g, unknown or other
tgtgagtagtcacgaccggtgctcgatttagagcgactagcaacacacaaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcagactcggaccctgaagtattttgcagtgtattactgtcagcagtatggtagctcacgatcaccttcggccaagggacacgactggagattaaccgaactgtggntgcacatctgtctt

SEQ ID NO: 553532 - DNA, 503 bp, Homo sapiens; identical to SEQ ID NO: 538884
  misc_feature: HIJSMM301A6Y1D.27.78.H01.1.454.light.4.raw

SEQ ID NO: 553533 - DNA, 493 bp, Homo sapiens
  misc_feature: HIJSMM301CYN3M.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttatactgtctacaagattacaattaccctcggacgttcggtccagggaccgaacggtggaaagtacaaacgaaacctgtggcgtgcacca

SEQ ID NO: 553534 - DNA, 494 bp, Homo sapiens
  misc_feature: HIJSMM301BEWJO.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccagactgaccgtcctaggtcagcccaagg

SEQ ID NO: 553535 - DNA, 488 bp, Homo sapiens; identical to SEQ ID NO: 552813
  misc_feature: HIJSMM301BGTHF.43.36.D03.1.454.light.4.raw

SEQ ID NO: 553536 - DNA, 505 bp, Homo sapiens
  misc_feature: HIJSMM301DJ5AA.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctcgccccctcggtcta

SEQ ID NO: 553537 - DNA, 491 bp, Homo sapiens
  misc_feature: HIJSMM301ERUU5.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagcccc

SEQ ID NO: 553538 - DNA, 494 bp, Homo sapiens; identical to SEQ ID NO: 535478
  misc_feature: HIJSMM301AV3CL.10.79.H02.1.454.light.4.raw

SEQ ID NO: 553539 - DNA, 505 bp, Homo sapiens; identical to SEQ ID NO: 552248
  misc_feature: HIJSMM301EV88O.11.67.G01.1.454.light.4.raw

SEQ ID NO: 553540 - DNA, 515 bp, Homo sapiens
  misc_feature: HIJSMM301BSS86.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctcg

SEQ ID NO: 553541 - DNA, 482 bp, Homo sapiens; identical to SEQ ID NO: 535920
  misc_feature: HIJSMM301A2735.19.71.G05.1.454.light.4.raw

SEQ ID NO: 553542 - DNA, 490 bp, Homo sapiens; identical to SEQ ID NO: 535234
  misc_feature: HIJSMM301CQ7PQ.17.21.B10.1.454.light.4.raw

SEQ ID NO: 553543 - DNA, 494 bp, Homo sapiens
  misc_feature: HIJSMM301C7TNI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagattaaaggaactgtggctgcacatctgtcttcatcttccccg

SEQ ID NO: 553544 - DNA, 486 bp, Homo sapiens
  misc_feature: HIJSMM301CXRW7.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccatcggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccat

SEQ ID NO: 553545 - DNA, 486 bp, Homo sapiens; identical to SEQ ID NO: 536261
  misc_feature: HIJSMM301DIQH2.26.55.E11.1.454.light.4.raw

SEQ ID NO: 553546 - DNA, 483 bp, Homo sapiens
  misc_feature: HIJSMM301B21QB.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaagctgaccgtcctaggtc

SEQ ID NO: 553547 - DNA, 502 bp, Homo sapiens; identical to SEQ ID NO: 541501
  misc_feature: HIJSMM301BG95E.17.27.C05.1.454.light.4.raw

SEQ ID NO: 553548 - DNA, 498 bp, Homo sapiens
  misc_feature: HIJSMM301D6UGZ.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgtcgccacggacgaacgtaggaagtacaagacgaactagtggcgtgcaccactctgtcttc

SEQ ID NO: 553549 - DNA, 480 bp, Homo sapiens; identical to SEQ ID NO: 535630
  misc_feature: HIJSMM301CFQDH.40.59.F04.1.454.light.4.raw

SEQ ID NO: 553550 - DNA, 454 bp, Homo sapiens; identical to SEQ ID NO: 534964
  misc_feature: HIJSMM301BSI90.19.86.H09.1.454.light.4.raw

SEQ ID NO: 553551 - DNA, 482 bp, Homo sapiens; identical to SEQ ID NO: 550464
  misc_feature: HIJSMM301A8UCR.13.50.E06.1.454.light.4.raw

SEQ ID NO: 553552 - DNA, 508 bp, Homo sapiens; identical to SEQ ID NO: 541017
  misc_feature: HIJSMM301CYK5V.17.33.C11.1.454.light.4.raw

SEQ ID NO: 553553 - DNA, 498 bp, Homo sapiens
  misc_feature: HIJSMM301A1OGO.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctaaaccatcaaacagccctagagcctgacgattctgcagtttattactgtcagcagcgtaccaagtggcctccgacttttggccagggggccaagctggagatcagacgaactgtggctgcaccatctgtcttcatctcccg

SEQ ID NO: 553554 - DNA, 497 bp, Homo sapiens
  misc_feature: HIJSMM301EMCHI.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccaaactgaccgtcctaggtcagcccaaggctgccccctcggtcactctgttccccg

SEQ ID NO: 553555 - DNA, 514 bp, Homo sapiens
  misc_feature: HIJSMM301AG0UY.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttcccgccctcct

SEQ ID NO: 553556 - DNA, 485 bp, Homo sapiens
  misc_feature: HIJSMM301DL3YC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccagctggagatcaaacgaactgtggctgcaccat

SEQ ID NO: 553557 - DNA, 447 bp, Homo sapiens; identical to SEQ ID NO: 535020
  misc_feature: HIJSMM301C6JA4.18.9.A09.1.454.light.4.raw

SEQ ID NO: 553558 - DNA, 487 bp, Homo sapiens
  misc_feature: HIJSMM301CXTX6.47.78.H01.1.454.light.4.raw
  modified_base (292)..(292): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgatcttttcnggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 553559 - DNA, 489 bp, Homo sapiens
  misc_feature: HIJSMM301AHKP8.43.21.B10.1.454.light.4.raw
tgtgagtagtcacgaccggtgctcgatttagtgtcgtcgcaagagaggagggggaagagctgctcagttaggacccagagggaaccatggaaacccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcaggtatggtagctcacaggggacgttcggccaagggaccaaggtggaaatcaacgaacctgtggctgcaccat

SEQ ID NO: 553560 - DNA, 493 bp, Homo sapiens
  misc_feature: HIJSMM301CPG1P.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggtgattattactgcagctcatatagaagtggcagcactctcgtattcggcggtgggaccaagctgaccgtcctaggtcagcccaagg

SEQ ID NO: 553561 - DNA, 499 bp, Homo sapiens
  misc_feature: HIJSMM301CDCUY.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaagctgtggctgcaccta

SEQ ID NO: 553562 - DNA, 502 bp, Homo sapiens
  misc_feature: HIJSMM301D5DMQ.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaagtagatgtcaaacgaactgtggctgcaccatctgtctt

SEQ ID NO: 553563 - DNA, 513 bp, Homo sapiens; identical to SEQ ID NO: 535719
  misc_feature: HIJSMM301E1Q1P.17.33.C11.1.454.light.4.raw

SEQ ID NO: 553564 - DNA, 484 bp, Homo sapiens; identical to SEQ ID NO: 537878
  misc_feature: HIJSMM301CC7SY.17.34.D01.1.454.light.4.raw

SEQ ID NO: 553565 - DNA, 506 bp, Homo sapiens
  misc_feature: HIJSMM301A6Y0M.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccagactgaggacgaggctgattattactgcagctcacatacaagcggcagcggttgggtggttcggcggggggaccgacgactgaccgtcctaggtcagcccaacggctgtccccccg

SEQ ID NO: 553566 - DNA, 520 bp, Homo sapiens
  misc_feature: HIJSMM301DXK80.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccaccct

SEQ ID NO: 553567 - DNA, 486 bp, Homo sapiens; identical to SEQ ID NO: 535043
  misc_feature: HIJSMM301AO3RZ.46.35.D02.1.454.light.4.raw

SEQ ID NO: 553568 - DNA, 493 bp, Homo sapiens; identical to SEQ ID NO: 535047
  misc_feature: HIJSMM301DLAWX.16.53.E09.1.454.light.4.raw

SEQ ID NO: 553569 - DNA, 504 bp, Homo sapiens; identical to SEQ ID NO: 553228
  misc_feature: HIJSMM301CDM19.19.85.H08.1.454.light.4.raw

SEQ ID NO: 553570 - DNA, 521 bp, Homo sapiens; identical to SEQ ID NO: 539470
  misc_feature: HIJSMM301BJOCK.27.23.C01.1.454.light.4.raw

SEQ ID NO: 553571 - DNA, 486 bp, Homo sapiens; identical to SEQ ID NO: 535043
  misc_feature: HIJSMM301CO1ZI.46.35.D02.1.454.light.4.raw

SEQ ID NO: 553572 - DNA, 498 bp, Homo sapiens
  misc_feature: HIJSMM301BS0CN.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggaagatcaaacgaactgtggctgcaccatctgtcttcatcttcccgccatctgac

SEQ ID NO: 553573 - DNA, 490 bp, Homo sapiens
  misc_feature: HIJSMM301CSXN3.48.87.H10.1.454.light.4.raw
agtatacatacacgaccggtgctcgatttagcagtactgcgttgggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 553574 - DNA, 472 bp, Homo sapiens; identical to SEQ ID NO: 535992
  misc_feature: HIJSMM301E1FW0.11.76.G10.1.454.light.4.raw

SEQ ID NO: 553575 - DNA, 490 bp, Homo sapiens
  misc_feature: HIJSMM301A9PB3.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctggaggatggttggggtttattactgcatgcaagttctacaaacttcctactacttttggccaggggaccaagctggagatcaaacgaa

SEQ ID NO: 553576 - DNA, 508 bp, Homo sapiens
  misc_feature: HIJSMM301EIFAF.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgcctgactcagcctgcctccgtgtctgggtcgtcctggacagtcgatcaccatctcctgcactggaaccagcagtgacgttggtggttataactatgtctcctggtaccaacagcacccaggcaaacgacccccaaacctacatgtatttatgatgtcactaatcggccctcagggtttctaatcgcttctctggctccaagtctggcaacacggcctccctgaccatctctgggctccaggctgaggacgaggctgattattactgcagctcatataacaagcaccagcactctctatgtcttcggaactgggaccaaacggtcacccgtaccttaggcagccccaagga

SEQ ID NO: 553577 - DNA, 503 bp, Homo sapiens; identical to SEQ ID NO: 552945
  misc_feature: HIJSMM301ANSHE.17.61.F06.1.454.light.4.raw

SEQ ID NO: 553578 - DNA, 507 bp, Homo sapiens
  misc_feature: HIJSMM301EO78E.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaaattgagatcaaacgaactgtggctgcaccatctgtcttctatt

SEQ ID NO: 553579 - DNA, 460 bp, Homo sapiens; identical to SEQ ID NO: 537107
  misc_feature: HIJSMM301CDCW4.22.28.C06.1.454.light.4.raw

SEQ ID NO: 553580 - DNA, 487 bp, Homo sapiens
  misc_feature: HIJSMM301B8QUK.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgcctcctcga

SEQ ID NO: 553581 - DNA, 510 bp, Homo sapiens
  misc_feature: HIJSMM301AQD4G.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgcccccg

SEQ ID NO: 553582 - DNA, 473 bp, Homo sapiens
  misc_feature: HIJSMM301AMR57.53.85.H08.1.454.light.4.raw
cgcgtatacacacgaccggtgctcgatttagtatcactcagtcgcgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggaactggga

SEQ ID NO: 553583 - DNA, 503 bp, Homo sapiens
  misc_feature: HIJSMM301D9B96.40.30.C08.1.454.light.4.raw
tctagcgactcacgaccggtgctcgatttagtctgacgtcaaagggaaagggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactacaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttatactgtcaacaatattttcatactcgccgacgttcgccggggaccaacgtgaaatcaaacgaactgtggctgcaccatctgtcttca

SEQ ID NO: 553584 - DNA, 487 bp, Homo sapiens
  misc_feature: HIJSMM301BKTE6.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaatgaaacgaactgtggctgcaccat

SEQ ID NO: 553585 - DNA, 487 bp, Homo sapiens; identical to SEQ ID NO: 541307
  misc_feature: HIJSMM301DMELD.19.71.G05.1.454.light.4.raw

SEQ ID NO: 553586 - DNA, 464 bp, Homo sapiens; identical to SEQ ID NO: 539492
  misc_feature: HIJSMM301BLL21.18.59.F04.1.454.light.4.raw

SEQ ID NO: 553587 - DNA, 489 bp, Homo sapiens
  misc_feature: HIJSMM301DZQD8.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcttacacttttggcagggaccaagctggagatcaacgaactgtgg

SEQ ID NO: 553588 - DNA, 503 bp, Homo sapiens; identical to SEQ ID NO: 547049
  misc_feature: HIJSMM301EMK23.18.59.F04.1.454.light.4.raw

SEQ ID NO: 553589 - DNA, 512 bp, Homo sapiens; identical to SEQ ID NO: 541300
  misc_feature: HIJSMM301BZVIE.17.33.C11.1.454.light.4.raw

SEQ ID NO: 553590 - DNA, 493 bp, Homo sapiens
  misc_feature: HIJSMM301DI8G6.40.35.D02.1.454.light.4.raw
tctagcgactcacgaccggtgctcgatttagcacacgatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggaggaccgagctgaccgtcctacgtcagcccaa

SEQ ID NO: 553591 - DNA, 477 bp, Homo sapiens; identical to SEQ ID NO: 543928
  misc_feature: HIJSMM301ENSGN.16.86.H09.1.454.light.4.raw

SEQ ID NO: 553592 - DNA, 485 bp, Homo sapiens
  misc_feature: HIJSMM301DKKKK.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctcggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacgaa

SEQ ID NO: 553593 - DNA, 485 bp, Homo sapiens; identical to SEQ ID NO: 535688
  misc_feature: HIJSMM301D0FR0.19.5.A05.1.454.light.4.raw

SEQ ID NO: 553594 - DNA, 464 bp, Homo sapiens; identical to SEQ ID NO: 542703
  misc_feature: HIJSMM301EEXNS.11.73.G07.1.454.light.4.raw

SEQ ID NO: 553595 - DNA, 494 bp, Homo sapiens; identical to SEQ ID NO: 534992
  misc_feature: HIJSMM301EOFOY.9.1.A01.1.454.light.4.raw

SEQ ID NO: 553596 - DNA, 482 bp, Homo sapiens; identical to SEQ ID NO: 535920
  misc_feature: HIJSMM301C2759.19.71.G05.1.454.light.4.raw

SEQ ID NO: 553597 - DNA, 498 bp, Homo sapiens; identical to SEQ ID NO: 535974
  misc_feature: HIJSMM301DGY14.22.27.C05.1.454.light.4.raw

SEQ ID NO: 553598 - DNA, 484 bp, Homo sapiens
  misc_feature: HIJSMM301DFSF2.48.42.D09.1.454.light.4.raw
agtatacatacacgaccggtgctcgatttagacacatacgcagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaa

SEQ ID NO: 553599 - DNA, 511 bp, Homo sapiens; identical to SEQ ID NO: 548214
  misc_feature: HIJSMM301CKOU6.19.59.F04.1.454.light.4.raw

SEQ ID NO: 553600 - DNA, 486 bp, Homo sapiens; identical to SEQ ID NO: 542999
  misc_feature: HIJSMM301EI9KW.17.55.E11.1.454.light.4.raw

SEQ ID NO: 553601 - DNA, 447 bp, Homo sapiens; identical to SEQ ID NO: 535020
  misc_feature: HIJSMM301AUIZ6.18.9.A09.1.454.light.4.raw

SEQ ID NO: 553602 - DNA, 507 bp, Homo sapiens
  misc_feature: HIJSMM301EE73X.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactcttcg

SEQ ID NO: 553603 - DNA, 507 bp, Homo sapiens
  misc_feature: HIJSMM301D7VP7.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctcaactctggaaacacggccaccctgaccatcagcagggtcgaagccggggatgaggccgactattactgtcaggtgtggatagtagtggtgatcatccatacgtcttcggaactgggaccgaaggtctccgtcctacgtcacgcccaacggaccaactccactgtcactt

SEQ ID NO: 553604 - DNA, 479 bp, Homo sapiens
  misc_feature: HIJSMM301CCGDT.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcgggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgt

SEQ ID NO: 553605 - DNA, 492 bp, Homo sapiens; identical to SEQ ID NO: 535126
  misc_feature: HIJSMM301BJ9TL.18.11.A11.1.454.light.4.raw

SEQ ID NO: 553606 - DNA, 504 bp, Homo sapiens
  misc_feature: HIJSMM301ECI22.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggaggattaaacgaactagtggctgcaccatctgtcttcatcttcccgccta

SEQ ID NO: 553607 - DNA, 497 bp, Homo sapiens; identical to SEQ ID NO: 535740
  misc_feature: HIJSMM301BS97M.3.71.G05.1.454.light.4.raw

SEQ ID NO: 553608 - DNA, 486 bp, Homo sapiens
  misc_feature: HIJSMM301DRJ56.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccc

SEQ ID NO: 553609 - DNA, 453 bp, Homo sapiens
  misc_feature: HIJSMM301BKDPP.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgacgtcctaagtcagcgcaaggctgccccctcggtcactctgttcccaccctcctccacgagagta

SEQ ID NO: 553610 - DNA, 490 bp, Homo sapiens; identical to SEQ ID NO: 535234
  misc_feature: HIJSMM301DDRE4.17.21.B10.1.454.light.4.raw

SEQ ID NO: 553611 - DNA, 478 bp, Homo sapiens; identical to SEQ ID NO: 543315
  misc_feature: HIJSMM301EWMNT.26.72.G06.1.454.light.4.raw

SEQ ID NO: 553612 - DNA, 519 bp, Homo sapiens; identical to SEQ ID NO: 541985
  misc_feature: HIJSMM301EC6Q2.41.25.C03.1.454.light.4.raw

SEQ ID NO: 553613 - DNA, 526 bp, Homo sapiens
  misc_feature: HIJSMM301AF1C6.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggcctgactattactcgcctactcttactttggtggtgctgtgctattcggcgggacgggaccaagctcgaccgttcttaagtcacgcccaaggctcgccccctcggtcactctcgttcccaccctcctcc

SEQ ID NO: 553614 - DNA, 504 bp, Homo sapiens
  misc_feature: HIJSMM301AW48W.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaagtggatatcaaacgaactgtggctgcaccatctgtt

SEQ ID NO: 553615 - DNA, 496 bp, Homo sapiens; identical to SEQ ID NO: 537225
  misc_feature: HIJSMM301EIBKX.11.59.F04.1.454.light.4.raw

SEQ ID NO: 553616 - DNA, 501 bp, Homo sapiens
  misc_feature: HIJSMM301AJMOD.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggtccaggggaccaagctggagatcaaacgaactgtggctgcacca

SEQ ID NO: 553617 - DNA, 480 bp, Homo sapiens
  misc_feature: HIJSMM301BPXN9.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcacc

SEQ ID NO: 553618 - DNA, 444 bp, Homo sapiens; identical to SEQ ID NO: 535594
  misc_feature: HIJSMM301DE7YB.9.9.A09.1.454.light.4.raw

SEQ ID NO: 553619 - DNA, 486 bp, Homo sapiens; identical to SEQ ID NO: 536555
  misc_feature: HIJSMM301AJ8CB.26.23.C01.1.454.light.4.raw

SEQ ID NO: 553620 - DNA, 499 bp, Homo sapiens
  misc_feature: HIJSMM301DMEXE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgaccatcagtgggctccggtccgaggatgaggctgactattactgtgcatcacgggacgcaacatgggatgacaatctgagcggttggtgttcggcggagggaccaaactgaccgtctaggtcagcccaa

SEQ ID NO: 553621 - DNA, 484 bp, Homo sapiens; identical to SEQ ID NO: 535400
  misc_feature: HIJSMM301DRZM0.46.26.C04.1.454.light.4.raw

SEQ ID NO: 553622 - DNA, 441 bp, Homo sapiens; identical to SEQ ID NO: 535074
  misc_feature: HIJSMM301ECSD2.11.3.A03.1.454.light.4.raw

SEQ ID NO: 553623 - DNA, 520 bp, Homo sapiens
  misc_feature: HIJSMM301B9NCV.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgacggatgaggctgagtattactgcttgctctcctatagtggtgttcgggtgtttcggcggagggaccaagctgaccgtcctaggtcagcccaaggctgccccctggtcactctgttcccaccctctcctagtct

SEQ ID NO: 553624 - DNA, 512 bp, Homo sapiens
  misc_feature: HIJSMM301B88EC.9.14.B03.1.454.light.4.raw
  modified_base (443)..(443): a, c, t, g, unknown or other
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccacggcccccttctagtcatctatgaggacgccaggcgaccctccgggatccctgagagaatctcgggctccagttcagggacagtggccaccttgacgatcggtgggcccaggtggaagatgaagctgactacttctgttactcaacagacgacagtgcggatcatagaggatgttcggnggaggaccaagctgaccgtcctaggtcagcccaaggctcgccccctggtccactctcgttccccaccct

SEQ ID NO: 553625 - DNA, 488 bp, Homo sapiens
  misc_feature: HIJSMM301C1FSH.14.55.E11.1.454.light.4.raw
  modified_base (451)..(451): a, c, t, g, unknown or other
  modified_base (455)..(455): a, c, t, g, unknown or other
  modified_base (463)..(463): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgacggngatnagagaacngtggcgtgcaccactctgtcttcta

SEQ ID NO: 553626 - DNA, 498 bp, Homo sapiens
  misc_feature: HIJSMM301EMD6Y.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgaagaggctgattattactgcaggtcatatacaatcagcaacacttatgtcttcgggactgggaccaagatcaccgtcctaggtcagcccaaggccaacccactg

SEQ ID NO: 553627 - DNA, 500 bp, Homo sapiens
  misc_feature: HIJSMM301CW3WX.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaaggaccgaacggtaggaaagtacaacgaactagtggcgtcgcaccactctgtt

SEQ ID NO: 553628 - DNA, 490 bp, Homo sapiens; identical to SEQ ID NO: 535234
  misc_feature: HIJSMM301CK8HB.17.21.B10.1.454.light.4.raw

SEQ ID NO: 553629 - DNA, 499 bp, Homo sapiens
  misc_feature: HIJSMM301AY8PT.48.61.F06.1.454.light.4.raw
  modified_base (399)..(399): a, c, t, g, unknown or other
agtatacatacacgaccggtgctcgatttagctacgctctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctnttactgtcatcagactttttagttacgtcggaccttcggccaagggacacgactggagattaaacgaactgtggctgcaccatctgtcttcatcttcccg

SEQ ID NO: 553630 - DNA, 486 bp, Homo sapiens; identical to SEQ ID NO: 536323
  misc_feature: HIJSMM301APVPS.10.2.A02.1.454.light.4.raw

SEQ ID NO: 553631 - DNA, 464 bp, Homo sapiens; identical to SEQ ID NO: 537111
  misc_feature: HIJSMM301DMIRZ.17.28.C06.1.454.light.4.raw

SEQ ID NO: 553632 - DNA, 489 bp, Homo sapiens; identical to SEQ ID NO: 535139
  misc_feature: HIJSMM301DOVL2.14.55.E11.1.454.light.4.raw

SEQ ID NO: 553633 - DNA, 513 bp, Homo sapiens
  misc_feature: HIJSMM301B97TO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaaggaccgaacggtggaagtacaaacgaactagtggcgtgcaccactctgtcttctatcttcccgtccact

SEQ ID NO: 553634 - DNA, 508 bp, Homo sapiens; identical to SEQ ID NO: 536388
  misc_feature: HIJSMM301BD4J4.11.57.F02.1.454.light.4.raw

SEQ ID NO: 553635 - DNA, 440 bp, Homo sapiens; identical to SEQ ID NO: 539180
  misc_feature: HIJSMM301C18CQ.11.3.A03.1.454.light.4.raw

SEQ ID NO: 553636 - DNA, 522 bp, Homo sapiens
  misc_feature: HIJSMM301AEGBZ.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccggtcctaggtcagcccaaggctgccccctcggtcactctgttcccgccct

SEQ ID NO: 553637 - DNA, 503 bp, Homo sapiens
  misc_feature: HIJSMM301A4TI8.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctggtgttcggcggagggaccaaactgaccgtcctaggtcagcccaaggctgccccctcggtcactctgtt

SEQ ID NO: 553638 - DNA, 479 bp, Homo sapiens
  misc_feature: HIJSMM301BUSW5.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgactgtggctgca

SEQ ID NO: 553639 - DNA, 496 bp, Homo sapiens
  misc_feature: HIJSMM301B8LOS.48.63.F08.1.454.light.4.raw
agtatacatacacgaccggtgctcgatttagcgatcgtataaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggtccagggactaagctggagatcaaacgaactgtggctgcaccatctgtcttcatcttccccg

SEQ ID NO: 553640 - DNA, 447 bp, Homo sapiens; identical to SEQ ID NO: 535201
  misc_feature: HIJSMM301AETXC.18.9.A09.1.454.light.4.raw

SEQ ID NO: 553641 - DNA, 485 bp, Homo sapiens; identical to SEQ ID NO: 538533
  misc_feature: HIJSMM301A53UU.47.78.H01.1.454.light.4.raw

SEQ ID NO: 553642 - DNA, 495 bp, Homo sapiens
  misc_feature: HIJSMM301CUJJV.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttatactgtcagcaatattatagtactcctccgaggctcactttcggcggagggaccaaggtggagatcaaacgaactgt

SEQ ID NO: 553643 - DNA, 518 bp, Homo sapiens; identical to SEQ ID NO: 543797
  misc_feature: HIJSMM301E05N3.19.80.H03.1.454.light.4.raw

SEQ ID NO: 553644 - DNA, 489 bp, Homo sapiens; identical to SEQ ID NO: 535139
  misc_feature: HIJSMM301CR5HV.14.55.E11.1.454.light.4.raw

SEQ ID NO: 553645 - DNA, 485 bp, Homo sapiens; identical to SEQ ID NO: 543370
  misc_feature: HIJSMM301C8B8F.3.10.A10.1.454.light.4.raw

SEQ ID NO: 553646 - DNA, 503 bp, Homo sapiens
  misc_feature: HIJSMM301AXOQQ.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcacgtggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgccctcctcagacgtatcta

SEQ ID NO: 553647 - DNA, 500 bp, Homo sapiens
  misc_feature: HIJSMM301A0S9U.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctg

SEQ ID NO: 553648 - DNA, 444 bp, Homo sapiens; identical to SEQ ID NO: 535027
  misc_feature: HIJSMM301A908T.8.73.G07.1.454.light.4.raw

SEQ ID NO: 553649 - DNA, 479 bp, Homo sapiens
  misc_feature: HIJSMM301B3PXN.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcgcctggaccaatgtggatatcaaacgaactgtggctgcaccatctgtt

SEQ ID NO: 553650 - DNA, 458 bp, Homo sapiens
  misc_feature: HIJSMM301DUK3M.13.23.C01.1.454.light.4.raw
tcacgtactacacgaccggtgctcgatttagtacacgtgattagggattgggggccgttcctgggcccgagtctgtgctgactcagccaccctcagcgtctgggacccccgggcagagggtcaccatctcttgttctgaaagcagctccaacaccggaactgggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgttcccacctcctctagtacgtga

SEQ ID NO: 553651 - DNA, 522 bp, Homo sapiens
  misc_feature: HIJSMM301AQA6I.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccgccct

SEQ ID NO: 553652 - DNA, 499 bp, Homo sapiens; identical to SEQ ID NO: 543887
  misc_feature: HIJSMM301BUHRG.10.65.F10.1.454.light.4.raw

SEQ ID NO: 553653 - DNA, 496 bp, Homo sapiens
  misc_feature: HIJSMM301AEZ4R.40.11.A11.1.454.light.4.raw
tctagcgactcacgaccggtgctcgatttagctacgactgcagggaggggcagcaagatggtgttgcagacccaggtcttcatttttctgttgctctggatctctgatgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactagtggctgcaccatctgtcttcatcttcccgccc

SEQ ID NO: 553654 - DNA, 509 bp, Homo sapiens; identical to SEQ ID NO: 535670
  misc_feature: HIJSMM301CO3M0.47.23.C01.1.454.light.4.raw

SEQ ID NO: 553655 - DNA, 505 bp, Homo sapiens; identical to SEQ ID NO: 542298
  misc_feature: HIJSMM301DMQX0.14.3.A03.1.454.light.4.raw

SEQ ID NO: 553656 - DNA, 352 bp, Homo sapiens; identical to SEQ ID NO: 535995
  misc_feature: HIJSMM301DZLF8.4.67.G01.1.454.light.4.raw

SEQ ID NO: 553657 - DNA, 488 bp, Homo sapiens
  misc_feature: HIJSMM301BXZID.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcacccatcagcggcctgcagcctgaagattttgcaacatattactgtcaacaatatgaagatctccccctcactttcgcggagggaccaaggtggagatcagacgaactgtggctgcacccatctgtcttt

SEQ ID NO: 553658 - DNA, 478 bp, Homo sapiens
  misc_feature: HIJSMM301CODFX.11.11.A11.1.454.light.4.raw
  modified_base (428)..(428): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggnggagggaccgcggtggagatcagacgaactgtggctgcaccatctgtctt

SEQ ID NO: 553659 - DNA, 515 bp, Homo sapiens
  misc_feature: HIJSMM301DVB8E.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctagtcagcccaaggcctgccccctcggtcactctgttcccaccct

SEQ ID NO: 553660 - DNA, 485 bp, Homo sapiens; identical to SEQ ID NO: 536075
  misc_feature: HIJSMM301EGUND.17.21.B10.1.454.light.4.raw

SEQ ID NO: 553661 - DNA, 486 bp, Homo sapiens
  misc_feature: HIJSMM301CH354.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggagatcaaaacg

SEQ ID NO: 553662 - DNA, 481 bp, Homo sapiens
  misc_feature: HIJSMM301BXRIX.48.86.H09.1.454.light.4.raw
agtatacatacacgaccggtgctcgatttagtgctatagacttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacagtcagcagtgaggtggttttcggcggagggaccaagctgaccgtcctaagtcagaccccg

SEQ ID NO: 553663 - DNA, 498 bp, Homo sapiens; identical to SEQ ID NO: 542384
  misc_feature: HIJSMM301B4FZQ.13.64.F09.1.454.light.4.raw

SEQ ID NO: 553664 - DNA, 477 bp, Homo sapiens
  misc_feature: HIJSMM301AXIMV.5.28.C06.1.454.light.4.raw
atcagacacgcacgaccggtgctcgatttagagctcacgtattgggtttgggggtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcacc

SEQ ID NO: 553665 - DNA, 487 bp, Homo sapiens
  misc_feature: HIJSMM301BI5IL.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagtattttgtcggtttattactgtcagcagtatgataactggctgtactacttttcggccgaggggaccaagctggagatcaggcgaactgtggctgca

SEQ ID NO: 553666 - DNA, 488 bp, Homo sapiens
  misc_feature: HIJSMM301COFJ1.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggaggaccaaggcggagatcagacgaactgtggctgcaccatctgtcttcta

SEQ ID NO: 553667 - DNA, 434 bp, Homo sapiens; identical to SEQ ID NO: 535153
  misc_feature: HIJSMM301BLUCC.18.5.A05.1.454.light.4.raw

SEQ ID NO: 553668 - DNA, 499 bp, Homo sapiens
  misc_feature: HIJSMM301EMBV6.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccaggctgaccgtcggcggtcagcccaaggctgccccctcggtcactctgttcccta

SEQ ID NO: 553669 - DNA, 521 bp, Homo sapiens; identical to SEQ ID NO: 539470
  misc_feature: HIJSMM301ENPB8.27.23.C01.1.454.light.4.raw

SEQ ID NO: 553670 - DNA, 509 bp, Homo sapiens
  misc_feature: HIJSMM301DF3AD.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatggaggctgattattactgcagctcatatgcaggcagcagcacgtcccatgtgatcgttcgggcggggaccagctcgaccgtctaggtcacgcccaaggctcgtcccccg

SEQ ID NO: 553671 - DNA, 494 bp, Homo sapiens; identical to SEQ ID NO: 534994
  misc_feature: HIJSMM301CCQX4.27.78.H01.1.454.light.4.raw

SEQ ID NO: 553672 - DNA, 493 bp, Homo sapiens; identical to SEQ ID NO: 535047
  misc_feature: HIJSMM301ASC67.16.53.E09.1.454.light.4.raw

SEQ ID NO: 553673 - DNA, 516 bp, Homo sapiens
  misc_feature: HIJSMM301BLTAF.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagacaattattatacttcctcctcgagtacgttcggaccgaaggaccgaaggtaggaaataccgaaacgaactggtcggctcgccaccacttcg

SEQ ID NO: 553674 - DNA, 499 bp, Homo sapiens; identical to SEQ ID NO: 536578
  misc_feature: HIJSMM301A1890.22.27.C05.1.454.light.4.raw

SEQ ID NO: 553675 - DNA, 510 bp, Homo sapiens
  misc_feature: HIJSMM301B7U3Q.51.27.C05.1.454.light.4.raw
cgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcact

SEQ ID NO: 553676 - DNA, 479 bp, Homo sapiens; identical to SEQ ID NO: 538734
  misc_feature: HIJSMM301BAJ68.8.53.E09.1.454.light.4.raw

SEQ ID NO: 553677 - DNA, 383 bp, Homo sapiens; identical to SEQ ID NO: 540698
  misc_feature: HIJSMM301AHTEZ.41.28.C06.1.454.light.4.raw

SEQ ID NO: 553678 - DNA, 478 bp, Homo sapiens; identical to SEQ ID NO: 545407
  misc_feature: HIJSMM301ASI6X.5.70.G04.1.454.light.4.raw

SEQ ID NO: 553679 - DNA, 448 bp, Homo sapiens; identical to SEQ ID NO: 540567
  misc_feature: HIJSMM301EG1W6.18.9.A09.1.454.light.4.raw

SEQ ID NO: 553680 - DNA, 480 bp, Homo sapiens; identical to SEQ ID NO: 535291
  misc_feature: HIJSMM301AYHKM.22.59.F04.1.454.light.4.raw

SEQ ID NO: 553681 - DNA, 499 bp, Homo sapiens
  misc_feature: HIJSMM301EPQB2.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttcattcc

SEQ ID NO: 553682 - DNA, 487 bp, Homo sapiens; identical to SEQ ID NO: 543137
  misc_feature: HIJSMM301BNLLX.40.83.H06.1.454.light.4.raw

SEQ ID NO: 553683 - DNA, 495 bp, Homo sapiens
  misc_feature: HIJSMM301ES4A0.48.1.A01.1.454.light.4.raw
agtatacatacacgaccggtgctcgatttagacgtctcatcaggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccg

SEQ ID NO: 553684 - DNA, 469 bp, Homo sapiens
  misc_feature: HIJSMM301ETQIS.51.1.A01.1.454.light.4.raw
cgatcgtatacacgaccggtgctcgatttagacgtctcatcaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtgggatcaaacgaactgtgg

SEQ ID NO: 553685 - DNA, 485 bp, Homo sapiens
  misc_feature: HIJSMM301D8LZO.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 553686 - DNA, 499 bp, Homo sapiens
  misc_feature: HIJSMM301EW5EY.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattaattatacttcgtggacgttcggccaagggaccgaaggtaggataatcagacgaactagtggc

SEQ ID NO: 553687 - DNA, 504 bp, Homo sapiens
  misc_feature: HIJSMM301AU6QA.19.78.H01.1.454.light.4.raw
tactctcgtgcacgaccggtgctcgatttagtgtgagtagtttgggtttggggggcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 553688 - DNA, 484 bp, Homo sapiens; identical to SEQ ID NO: 540581
  misc_feature: HIJSMM301BWIT1.3.88.H11.1.454.light.4.raw

SEQ ID NO: 553689 - DNA, 444 bp, Homo sapiens; identical to SEQ ID NO: 535192
  misc_feature: HIJSMM301ANQVG.5.9.A09.1.454.light.4.raw

SEQ ID NO: 553690 - DNA, 541 bp, Homo sapiens
  misc_feature: HIJSMM301BAZ9Y.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgccagtcctatgtactatagacggcctaggacgtcggtttccgtattgtcgtttccggtagtaccgttggggaacccaaagggttccaacccgttccctaaggtcagcccaaggcccaaccccct

SEQ ID NO: 553691 - DNA, 496 bp, Homo sapiens
  misc_feature: HIJSMM301B3GCK.51.41.D08.1.454.light.4.raw
cgatcgtatacacgaccggtgctcgatttagtcacgcgagaaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 553692 - DNA, 504 bp, Homo sapiens; identical to SEQ ID NO: 539690
  misc_feature: HIJSMM301BOZSV.47.65.F10.1.454.light.4.raw

SEQ ID NO: 553693 - DNA, 463 bp, Homo sapiens; identical to SEQ ID NO: 535062
  misc_feature: HIJSMM301AGPAV.11.73.G07.1.454.light.4.raw

SEQ ID NO: 553694 - DNA, 483 bp, Homo sapiens; identical to SEQ ID NO: 544786
  misc_feature: HIJSMM301CUSAL.46.26.C04.1.454.light.4.raw

SEQ ID NO: 553695 - DNA, 494 bp, Homo sapiens; identical to SEQ ID NO: 535276
  misc_feature: HIJSMM301A3RHM.16.6.A06.1.454.light.4.raw

SEQ ID NO: 553696 - DNA, 491 bp, Homo sapiens
  misc_feature: HIJSMM301CLXB3.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcacttcccg

SEQ ID NO: 553697 - DNA, 499 bp, Homo sapiens
  misc_feature: HIJSMM301AIZXC.48.61.F06.1.454.light.4.raw
agtatacatacacgaccggtgctcgatttagctacgctctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 553698 - DNA, 454 bp, Homo sapiens; identical to SEQ ID NO: 534964
  misc_feature: HIJSMM301AY7XR.19.86.H09.1.454.light.4.raw

SEQ ID NO: 553699 - DNA, 383 bp, Homo sapiens; identical to SEQ ID NO: 447524
  misc_feature: HIJSMM301A1YIF.41.26.C04.1.454.light.4.raw

SEQ ID NO: 553700 - DNA, 485 bp, Homo sapiens
  misc_feature: HIJSMM301C73PI.47.38.D05.1.454.light.4.raw
  modified_base (450)..(450): a, c, t, g, unknown or other
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctanacttttgccagggaccaagctggagatcaaacgaa

SEQ ID NO: 553701 - DNA, 521 bp, Homo sapiens; identical to SEQ ID NO: 539470
  misc_feature: HIJSMM301DXET9.27.23.C01.1.454.light.4.raw

SEQ ID NO: 553702 - DNA, 485 bp, Homo sapiens
  misc_feature: HIJSMM301D8XT5.47.60.F05.1.454.light.4.raw
agctcacgtacacgaccggtgctcgatttagtacgtcatcagggaaagggggaggaactgctcagttaggacccagacggaaccatggaagccccacgcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 553703 - DNA, 511 bp, Homo sapiens
  misc_feature: HIJSMM301DV95A.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgactcgcttcatgggcgtccagttctggggcgtgaccgctacctcaccatctccaacctccagtctgacgatgaggctgagtatcactgtggagagagccacacaattgatggccaagacggttgggtgttcggcggagggaccgaagctgaccgtcctaggtcacg

SEQ ID NO: 553704 - DNA, 507 bp, Homo sapiens; identical to SEQ ID NO: 540930
  misc_feature: HIJSMM301EKTGD.8.34.D01.1.454.light.4.raw

SEQ ID NO: 553705 - DNA, 503 bp, Homo sapiens; identical to SEQ ID NO: 537226
  misc_feature: HIJSMM301AK5KV.19.85.H08.1.454.light.4.raw

SEQ ID NO: 553706 - DNA, 511 bp, Homo sapiens
  misc_feature: HIJSMM301D5DW9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacgggaccaacggtggaagtacgaaacgaactagtggctgcaccatctgtcttcatcttcccgccact

SEQ ID NO: 553707 - DNA, 496 bp, Homo sapiens
  misc_feature: HIJSMM301AOJHD.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggctccctgaccatctctgggctccaggctgaagatgaggctgattattactgctgctcatttgcaggcgcctacacttgggtgttcggcggagggaccgaagactgaccgtcctaggtcagccaacggctgccccctcggtcactctgttcccaccctcctcacgtcg

SEQ ID NO: 553708 - DNA, 495 bp, Homo sapiens
  misc_feature: HIJSMM301DV3HQ.51.57.F02.1.454.light.4.raw
cgatcgtatacacgaccggtgctcgatttagctcgatatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 553709 - DNA, 503 bp, Homo sapiens
  misc_feature: HIJSMM301CEK9S.19.67.G01.1.454.light.4.raw
  modified_base (426)..(426): a, c, t, g, unknown or other
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatntttttctatcctccgtggacgttcggccaagggaccagggtggaaatcagacgaactgtggctgcaccatctgtctt

SEQ ID NO: 553710 - DNA, 499 bp, Homo sapiens; identical to SEQ ID NO: 535899
  misc_feature: HIJSMM301CHJR2.19.78.H01.1.454.light.4.raw

SEQ ID NO: 553711 - DNA, 447 bp, Homo sapiens; identical to SEQ ID NO: 535201
  misc_feature: HIJSMM301AR20A.18.9.A09.1.454.light.4.raw

SEQ ID NO: 553712 - DNA, 488 bp, Homo sapiens; identical to SEQ ID NO: 535081
  misc_feature: HIJSMM301A70WL.26.23.C01.1.454.light.4.raw

SEQ ID NO: 553713 - DNA, 514 bp, Homo sapiens
  misc_feature: HIJSMM301AJNSD.43.5.A05.1.454.light.4.raw
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctcgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccgccctcctcta

SEQ ID NO: 553714 - DNA, 404 bp, Homo sapiens; identical to SEQ ID NO: 535530
  misc_feature: HIJSMM301BPWO3.4.35.D02.1.454.light.4.raw

SEQ ID NO: 553715 - DNA, 507 bp, Homo sapiens; identical to SEQ ID NO: 542621
  misc_feature: HIJSMM301CDKTA.4.10.A10.1.454.light.4.raw

SEQ ID NO: 553716 - DNA, 510 bp, Homo sapiens
  misc_feature: HIJSMM301AH44E.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggaccgaggctgaccgtcctaagtcagcccaaggctcgccccctc

SEQ ID NO: 553717 - DNA, 486 bp, Homo sapiens; identical to SEQ ID NO: 535290
  misc_feature: HIJSMM301APRJS.3.12.B01.1.454.light.4.raw

SEQ ID NO: 553718 - DNA, 490 bp, Homo sapiens; identical to SEQ ID NO: 535526
  misc_feature: HIJSMM301ER06N.26.78.H01.1.454.light.4.raw

SEQ ID NO: 553719 - DNA, 485 bp, Homo sapiens; identical to SEQ ID NO: 536040
  misc_feature: HIJSMM301CZ3J9.15.1.A01.1.454.light.4.raw

SEQ ID NO: 553720 - DNA, 504 bp, Homo sapiens
  misc_feature: HIJSMM301DYIBB.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgattttactgcggaacatgggataccagcctgcatggtgtggttttcggcggagggaccaagctgaccgtcctaagtcagcccaaggctgccccccg

SEQ ID NO: 553721 - DNA, 497 bp, Homo sapiens
  misc_feature: HIJSMM301AHMRC.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcactatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 553722 - DNA, 501 bp, Homo sapiens; identical to SEQ ID NO: 548482
  misc_feature: HIJSMM301EIBFG.41.71.G05.1.454.light.4.raw

SEQ ID NO: 553723 - DNA, 471 bp, Homo sapiens; identical to SEQ ID NO: 536384
  misc_feature: HIJSMM301CT3DG.18.76.G10.1.454.light.4.raw

SEQ ID NO: 553724 - DNA, 474 bp, Homo sapiens
  misc_feature: HIJSMM301AV5RB.12.49.E05.1.454.light.4.raw
  modified_base (422)..(422): a, c, t, g, unknown or other
  modified_base (438)..(438): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagtggcagtggatctgggacagagttcactctcaccatcagcagcctgcagcctgaagatgttgcaacttattactgtcaaaagtntaacagtgcccccttnaccttcggccaagggacacgactggagattagaacg

SEQ ID NO: 553725 - DNA, 489 bp, Homo sapiens; identical to SEQ ID NO: 536013
  misc_feature: HIJSMM301BJ5T7.26.23.C01.1.454.light.4.raw

SEQ ID NO: 553726 - DNA, 482 bp, Homo sapiens
  misc_feature: HIJSMM301DR4SJ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttaccgtacccgtactactttgccgacgggaccaaactggacatacaaacgaactggtgctcgccac

SEQ ID NO: 553727 - DNA, 507 bp, Homo sapiens; identical to SEQ ID NO: 535641
  misc_feature: HIJSMM301A7Y4D.10.88.H11.1.454.light.4.raw

SEQ ID NO: 553728 - DNA, 488 bp, Homo sapiens; identical to SEQ ID NO: 536861
  misc_feature: HIJSMM301AH8HL.12.88.H11.1.454.light.4.raw

SEQ ID NO: 553729 - DNA, 505 bp, Homo sapiens
  misc_feature: HIJSMM301B7AH5.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgtcgtccaaggaccgaaggtaggaaagtacaaacgaaactagtggcgtgcaccaact

SEQ ID NO: 553730 - DNA, 497 bp, Homo sapiens; identical to SEQ ID NO: 536371
  misc_feature: HIJSMM301CNM49.16.78.H01.1.454.light.4.raw

SEQ ID NO: 553731 - DNA, 506 bp, Homo sapiens
  misc_feature: HIJSMM301DRJ32.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagccctgcaggctgaagatgtggcagtttattactgtcaacagttttctcggggcttcggccaagggaccaaggtggaaagtacaaacgaactgtggctgcaccatctgtcttctatcttccccg

SEQ ID NO: 553732 - DNA, 491 bp, Homo sapiens; identical to SEQ ID NO: 535176
  misc_feature: HIJSMM301A47T9.13.39.D06.1.454.light.4.raw

SEQ ID NO: 553733 - DNA, 494 bp, Homo sapiens; identical to SEQ ID NO: 539784
  misc_feature: HIJSMM301BGKCZ.22.57.F02.1.454.light.4.raw

SEQ ID NO: 553734 - DNA, 485 bp, Homo sapiens; identical to SEQ ID NO: 549954
  misc_feature: HIJSMM301BS9L1.4.2.A02.1.454.light.4.raw

SEQ ID NO: 553735 - DNA, 465 bp, Homo sapiens; identical to SEQ ID NO: 538267
  misc_feature: HIJSMM301EOCR8.40.48.E04.1.454.light.4.raw

SEQ ID NO: 553736 - DNA, 495 bp, Homo sapiens
  misc_feature: HIJSMM301EIWYG.48.84.H07.1.454.light.4.raw
agtatacatacacgaccggtgctcgatttagcagacgtctgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcatgggacagcaacactgcgattttcggcgggggaccaggctgaccgtcggcggtcagccaaggctgccccctcggtcactctcgtt

SEQ ID NO: 553737 - DNA, 462 bp, Homo sapiens; identical to SEQ ID NO: 553042
  misc_feature: HIJSMM301AN65Q.49.8.A08.1.454.light.4.raw

SEQ ID NO: 553738 - DNA, 492 bp, Homo sapiens
  misc_feature: HIJSMM301C79OX.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcaggtggaggctgaggatgttggaatttattactgcatgcaatcttcacactggcctccgtacacttttggccaggggaccaagctggagatacaaacgaactgtgg

SEQ ID NO: 553739 - DNA, 505 bp, Homo sapiens; identical to SEQ ID NO: 535503
  misc_feature: HIJSMM301AVED9.8.28.C06.1.454.light.4.raw

SEQ ID NO: 553740 - DNA, 494 bp, Homo sapiens
  misc_feature: HIJSMM301A4KS9.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacccttggccaagggacacgactggagattaaacgaactgtggctgcaccatctgtctt

SEQ ID NO: 553741 - DNA, 476 bp, Homo sapiens; identical to SEQ ID NO: 538611
  misc_feature: HIJSMM301B5EA7.7.81.H04.1.454.light.4.raw

SEQ ID NO: 553742 - DNA, 494 bp, Homo sapiens; identical to SEQ ID NO: 534992
  misc_feature: HIJSMM301A37FI.9.1.A01.1.454.light.4.raw

SEQ ID NO: 553743 - DNA, 486 bp, Homo sapiens
  misc_feature: HIJSMM301ECK6I.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtattttttagcctggtttcagcagaaaccagggaaacgcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaaacgaactgtggctgcacc

SEQ ID NO: 553744 - DNA, 505 bp, Homo sapiens
  misc_feature: HIJSMM301CDY7X.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcat

SEQ ID NO: 553745 - DNA, 502 bp, Homo sapiens; identical to SEQ ID NO: 549179
  misc_feature: HIJSMM301EIC20.14.57.F02.1.454.light.4.raw

SEQ ID NO: 553746 - DNA, 496 bp, Homo sapiens; identical to SEQ ID NO: 537925
  misc_feature: HIJSMM301B4C8Z.22.14.B03.1.454.light.4.raw

SEQ ID NO: 553747 - DNA, 495 bp, Homo sapiens
  misc_feature: HIJSMM301DQ8OV.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctattcttttctcttcggaactgggaccacggtcaccgtcctaggtcacgcccaacggaccaccca

SEQ ID NO: 553748 - DNA, 497 bp, Homo sapiens
  misc_feature: HIJSMM301DQM19.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctgggcagatttcactctcaccatcagcagcctgcaggctgaagatgtggcagtttattactgtcagcaatattatactcctcttccgacgttggccaaggaccaaggtaggaatcaaacgaactgtggctgcaccat

SEQ ID NO: 553749 - DNA, 493 bp, Homo sapiens
  misc_feature: HIJSMM301CUX63.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaacgaactgtggctgcaccatctgtctt

SEQ ID NO: 553750 - DNA, 488 bp, Homo sapiens
  misc_feature: HIJSMM301ANXN2.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggtaccaaagtggatatcaaacgaactgtggctgcaccatctgtt

SEQ ID NO: 553751 - DNA, 492 bp, Homo sapiens; identical to SEQ ID NO: 536010
  misc_feature: HIJSMM301CXMAM.10.20.B09.1.454.light.4.raw

SEQ ID NO: 553752 - DNA, 496 bp, Homo sapiens; identical to SEQ ID NO: 536802
  misc_feature: HIJSMM301EDIJR.5.24.C02.1.454.light.4.raw

SEQ ID NO: 553753 - DNA, 511 bp, Homo sapiens
  misc_feature: HIJSMM301AEAQW.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccgaaagtaggaaatcaaacgaactgtggctgcaccatctgtcttcatcttcccgccat

SEQ ID NO: 553754 - DNA, 499 bp, Homo sapiens
  misc_feature: HIJSMM301E26KP.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcgtccaagggacgacgactggagattaaacgaactagtggcgtgcaccaactctgtctt

SEQ ID NO: 553755 - DNA, 481 bp, Homo sapiens; identical to SEQ ID NO: 535993
  misc_feature: HIJSMM301EOO50.21.25.C03.1.454.light.4.raw

SEQ ID NO: 553756 - DNA, 484 bp, Homo sapiens; identical to SEQ ID NO: 535400
  misc_feature: HIJSMM301DXCAK.46.26.C04.1.454.light.4.raw

SEQ ID NO: 553757 - DNA, 486 bp, Homo sapiens
  misc_feature: HIJSMM301BTHHK.46.38.D05.1.454.light.4.raw
actagcagtacacgaccggtgctcgatttagtatctgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaacgaactgtggctgcaccat

SEQ ID NO: 553758 - DNA, 506 bp, Homo sapiens
  misc_feature: HIJSMM301DH00P.43.67.G01.1.454.light.4.raw
tgtgagtagtcacgaccggtgctcgatttagagtatacatattgggtttggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatcaaacgaactgtggctgcaccatctgtcttcatt

SEQ ID NO: 553759 - DNA, 503 bp, Homo sapiens; identical to SEQ ID NO: 547798
  misc_feature: HIJSMM301BRSGY.21.22.B11.1.454.light.4.raw

SEQ ID NO: 553760 - DNA, 454 bp, Homo sapiens; identical to SEQ ID NO: 536449
  misc_feature: HIJSMM301DXMYK.18.78.H01.1.454.light.4.raw

SEQ ID NO: 553761 - DNA, 489 bp, Homo sapiens; identical to SEQ ID NO: 535139
  misc_feature: HIJSMM301BRVII.14.55.E11.1.454.light.4.raw

SEQ ID NO: 553762 - DNA, 481 bp, Homo sapiens; identical to SEQ ID NO: 541494
  misc_feature: HIJSMM301APU3Q.51.76.G10.1.454.light.4.raw

SEQ ID NO: 553763 - DNA, 482 bp, Homo sapiens
  misc_feature: HIJSMM301E25OP.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccacttttcggcggagggaccaaggtggagatcaaacgaactgtggctgcacc

SEQ ID NO: 553764 - DNA, 514 bp, Homo sapiens; identical to SEQ ID NO: 550589
  misc_feature: HIJSMM301BFIVX.16.66.F11.1.454.light.4.raw

SEQ ID NO: 553765 - DNA, 464 bp, Homo sapiens; identical to SEQ ID NO: 539492
  misc_feature: HIJSMM301BMVMM.18.59.F04.1.454.light.4.raw

SEQ ID NO: 553766 - DNA, 502 bp, Homo sapiens; identical to SEQ ID NO: 541971
  misc_feature: HIJSMM301DY1YY.4.39.D06.1.454.light.4.raw

SEQ ID NO: 553767 - DNA, 507 bp, Homo sapiens; identical to SEQ ID NO: 539466
  misc_feature: HIJSMM301CNJVB.8.33.C11.1.454.light.4.raw

SEQ ID NO: 553768 - DNA, 490 bp, Homo sapiens
  misc_feature: HIJSMM301DFPB4.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaagggaccgaaggtggaaagtcaaacgaactagtggctgcaccact

SEQ ID NO: 553769 - DNA, 503 bp, Homo sapiens
  misc_feature: HIJSMM301EGIZI.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtaccttacaggatatactggttccagcagaaggcagggagtcctccccagtttctcctaaattacaaatctgactcacgtaagcagcagggctctggagtccccagccgcttctctggatccaaagatggcttcggccaatgcggggattttactcatctctgggctccagtctgaggatgaggctgactattactgtttgatttggctacagctagcgcttgggtatttcggcgggggaccgaaactgaccgtcctaggtcagcccaaggctgcccctcggt

SEQ ID NO: 553770 - DNA, 494 bp, Homo sapiens; identical to SEQ ID NO: 535478
  misc_feature: HIJSMM301D1IWM.10.79.H02.1.454.light.4.raw

SEQ ID NO: 553771 - DNA, 490 bp, Homo sapiens; identical to SEQ ID NO: 535234
  misc_feature: HIJSMM301AL6JN.17.21.B10.1.454.light.4.raw

SEQ ID NO: 553772 - DNA, 461 bp, Homo sapiens
  misc_feature: HIJSMM301A9UBS.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggtcggagggaccaagctgaccgtcctaggtcagcccaaggctgccccctcggtcactctgttcccaccctcctcgtatctctcg

SEQ ID NO: 553773 - DNA, 504 bp, Homo sapiens
  misc_feature: HIJSMM301CRYQ2.7.31.C09.1.454.light.4.raw
cgtgtctctacacgaccggtgctcgatttagacgtctcatcaaggaaggaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagaccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 553774 - DNA, 505 bp, Homo sapiens; identical to SEQ ID NO: 536254
  misc_feature: HIJSMM301BZK33.7.71.G05.1.454.light.4.raw

SEQ ID NO: 553775 - DNA, 481 bp, Homo sapiens
  misc_feature: HIJSMM301DUI86.5.15.B04.1.454.light.4.raw
atcagacacgcacgaccggtgctcgatttagacagtatatagtccgcgggggagtcagactcagtcaggacacagcatggacatgagggtccccgctcagctcctggggctcctgctgctctggctcccaggtgccaaatgtgacatccagatgacccagtctccgttccaccctgtcctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcaccta

SEQ ID NO: 553776 - DNA, 516 bp, Homo sapiens
  misc_feature: HIJSMM301BN6X5.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctcgcccgacttctcaggctccctccttgggggcgaaagctgccctcgacactgtctggtgtgcagcctgaggacgaggctgactattactgcctactctactttggtggtgctgtgctattcggcggagggaccgaagctgaccgtcttaagtcagcccaaggctgccccctccggtcactctgttcccgt

SEQ ID NO: 553777 - DNA, 497 bp, Homo sapiens
  misc_feature: HIJSMM301A0P58.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaacggtggaaggtcaaacgaactagtggcgtgcaccatctgtctt

SEQ ID NO: 553778 - DNA, 487 bp, Homo sapiens; identical to SEQ ID NO: 536206
  misc_feature: HIJSMM301B99DR.47.38.D05.1.454.light.4.raw

SEQ ID NO: 553779 - DNA, 503 bp, Homo sapiens; identical to SEQ ID NO: 537226
  misc_feature: HIJSMM301BYB8P.19.85.H08.1.454.light.4.raw

SEQ ID NO: 553780 - DNA, 512 bp, Homo sapiens
  misc_feature: HIJSMM301D8DL0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccgaacgggaccaaaggtggaaagtcaaaacgaacctagtggctgcaccaatctgtcttcatcttccccg

SEQ ID NO: 553781 - DNA, 514 bp, Homo sapiens
  misc_feature: HIJSMM301ARIDD.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgcctccctcgctacgtaga

SEQ ID NO: 553782 - DNA, 503 bp, Homo sapiens
  misc_feature: HIJSMM301AX0LH.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcg

SEQ ID NO: 553783 - DNA, 518 bp, Homo sapiens
  misc_feature: HIJSMM301CLMBH.41.19.B08.1.454.light.4.raw
tctatactatcacgaccggtgctcgatttagtgagtcagtaaggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgccctcct

SEQ ID NO: 553784 - DNA, 450 bp, Homo sapiens
  misc_feature: HIJSMM301BBYHT.40.14.B03.1.454.light.4.raw
tctagcgactcacgaccggtgctcgatttagtgtgagtagttccgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagggggtcatgatctcttgttttggaagtagctccaacatcggaagtaataatgtgaactggtctggcacctcagccctccctggccatcattgatctccagtctgaggatgaggctgactattactgttcagcatgggatgccagcctgaatgtctgggtgttcggcggaggaccaagttgaccgtcctaggtcagcccgaaggctcgccccctcggtcactctcgttccccgccctcagtcgctaga

SEQ ID NO: 553785 - DNA, 485 bp, Homo sapiens; identical to SEQ ID NO: 541838
  misc_feature: HIJSMM301DTOAN.22.6.A06.1.454.light.4.raw

SEQ ID NO: 553786 - DNA, 504 bp, Homo sapiens
  misc_feature: HIJSMM301BMOBM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaaagtacaaacgaactagtggctgcaccatctgtcttcatcttccccg

SEQ ID NO: 553787 - DNA, 487 bp, Homo sapiens; identical to SEQ ID NO: 537573
  misc_feature: HIJSMM301AO3WN.3.10.A10.1.454.light.4.raw

SEQ ID NO: 553788 - DNA, 489 bp, Homo sapiens; identical to SEQ ID NO: 535139
  misc_feature: HIJSMM301ER7EE.14.55.E11.1.454.light.4.raw

SEQ ID NO: 553789 - DNA, 470 bp, Homo sapiens; identical to SEQ ID NO: 536130
  misc_feature: HIJSMM301BQ0VQ.7.81.H04.1.454.light.4.raw

SEQ ID NO: 553790 - DNA, 473 bp, Homo sapiens
  misc_feature: HIJSMM301BL4O8.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgatttgctcctccgagtgccacttttggcggggggaccgaacggtggacgatcaaacgaa

SEQ ID NO: 553791 - DNA, 468 bp, Homo sapiens
  misc_feature: HIJSMM301CU90O.49.82.H05.1.454.light.4.raw
agtcgagagacacgaccggtgctcgatttagtcgagctctctcgcgggcacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcgacc

SEQ ID NO: 553792 - DNA, 489 bp, Homo sapiens; identical to SEQ ID NO: 536919
  misc_feature: HIJSMM301BGRGE.22.86.H09.1.454.light.4.raw

SEQ ID NO: 553793 - DNA, 447 bp, Homo sapiens; identical to SEQ ID NO: 535201
  misc_feature: HIJSMM301ARGLX.18.9.A09.1.454.light.4.raw

SEQ ID NO: 553794 - DNA, 492 bp, Homo sapiens; identical to SEQ ID NO: 534967
  misc_feature: HIJSMM301DNTAQ.47.64.F09.1.454.light.4.raw

SEQ ID NO: 553795 - DNA, 519 bp, Homo sapiens
  misc_feature: HIJSMM301EN0EX.48.72.G06.1.454.light.4.raw
agtatacatacacgaccggtgctcgatttagctacgactgcaagggaaaggggctgggcctaaggaagcagcactggtggtgcctcagccatggcctggaccgttctcctcctcggcctcctctctcactgcacaggctccgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccacct

SEQ ID NO: 553796 - DNA, 486 bp, Homo sapiens
  misc_feature: HIJSMM301C1YAH.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctac

SEQ ID NO: 553797 - DNA, 500 bp, Homo sapiens
  misc_feature: HIJSMM301A3VWZ.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggtccaagggaccaacggtaggacgagtacaaacgaaactagtggctgcaccactctgtctt

SEQ ID NO: 553798 - DNA, 493 bp, Homo sapiens; identical to SEQ ID NO: 535745
  misc_feature: HIJSMM301C5RTB.47.78.H01.1.454.light.4.raw

SEQ ID NO: 553799 - DNA, 524 bp, Homo sapiens
  misc_feature: HIJSMM301B3BO4.40.27.C05.1.454.light.4.raw
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccgccctcctcagtcg

SEQ ID NO: 553800 - DNA, 500 bp, Homo sapiens; identical to SEQ ID NO: 535083
  misc_feature: HIJSMM301BZS42.49.69.G03.1.454.light.4.raw

SEQ ID NO: 553801 - DNA, 486 bp, Homo sapiens; identical to SEQ ID NO: 540090
  misc_feature: HIJSMM301C9VEP.17.36.D03.1.454.light.4.raw

SEQ ID NO: 553802 - DNA, 464 bp, Homo sapiens
  misc_feature: HIJSMM301B6KBQ.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaacagccgggtggagagtgaccatgttggaacttatta

SEQ ID NO: 553803 - DNA, 444 bp, Homo sapiens; identical to SEQ ID NO: 535192
  misc_feature: HIJSMM301BJOSV.5.9.A09.1.454.light.4.raw

SEQ ID NO: 553804 - DNA, 489 bp, Homo sapiens
  misc_feature: HIJSMM301AQGC9.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaacggtaggaaatacaaacgaactagtggctgcaccta

SEQ ID NO: 553805 - DNA, 478 bp, Homo sapiens; identical to SEQ ID NO: 535129
  misc_feature: HIJSMM301C4RWZ.11.11.A11.1.454.light.4.raw

SEQ ID NO: 553806 - DNA, 493 bp, Homo sapiens; identical to SEQ ID NO: 544335
  misc_feature: HIJSMM301EPFSF.5.57.F02.1.454.light.4.raw

SEQ ID NO: 553807 - DNA, 522 bp, Homo sapiens
  misc_feature: HIJSMM301BC43O.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctcgccccctcggtcactctgttcccgccct

SEQ ID NO: 553808 - DNA, 484 bp, Homo sapiens; identical to SEQ ID NO: 538770
  misc_feature: HIJSMM301A970Z.4.57.F02.1.454.light.4.raw

SEQ ID NO: 553809 - DNA, 499 bp, Homo sapiens
  misc_feature: HIJSMM301D7TK9.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacttcggcggagggaccaaaggtggagatcaaacgaactgtggctgcaccatctgtcttcatcttccccg

SEQ ID NO: 553810 - DNA, 434 bp, Homo sapiens; identical to SEQ ID NO: 535153
  misc_feature: HIJSMM301BJN05.18.5.A05.1.454.light.4.raw

SEQ ID NO: 553811 - DNA, 484 bp, Homo sapiens
  misc_feature: HIJSMM301CY6UT.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtctaggtcagcccaaggctgccccccg

SEQ ID NO: 553812 - DNA, 509 bp, Homo sapiens; identical to SEQ ID NO: 539359
  misc_feature: HIJSMM301AHH2O.47.85.H08.1.454.light.4.raw

SEQ ID NO: 553813 - DNA, 504 bp, Homo sapiens
  misc_feature: HIJSMM301A0PWQ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaaacatgggatgacaatctgagcggttgggtgttcggcggagggaccaaactgaccgtcctaggtcagcccaa

SEQ ID NO: 553814 - DNA, 484 bp, Homo sapiens
  misc_feature: HIJSMM301D4D89.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagacttttggccagggaccaagctggagatcaaacgaactgtggctgcaccat

SEQ ID NO: 553815 - DNA, 502 bp, Homo sapiens
  misc_feature: HIJSMM301DC4O3.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggccaaggtggagatcaaacgaactgtggctgcaccatct

SEQ ID NO: 553816 - DNA, 476 bp, Homo sapiens
  misc_feature: HIJSMM301EF8Z6.19.77.G11.1.454.light.4.raw
tactctcgtgcacgaccggtgctcgatttagctagtcactcaagggaaagggtgacatccctcactgtggctcacgttcggcggagggaccgaggtggagatcaaacgtaagtgcactatccgaatgctttttgttataaggtttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttctctgcatcggtcaggttagtgatattaacagagaaaagagatttttgttaaggggaaagtaattaagctaacactgtggatcaccttcggccaagggacacgactggagattaaacgaactgtggctgcaccatctgtcttcatcttcccgccatctgacacgagagta

SEQ ID NO: 553817 - DNA, 492 bp, Homo sapiens
  misc_feature: HIJSMM301C9ONB.27.78.H01.1.454.light.4.raw
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactgtggctgcaccatctgtctt

SEQ ID NO: 553818 - DNA, 534 bp, Homo sapiens
  misc_feature: HIJSMM301CXU6K.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatggaggctggttattattgtcgtcgtcgtctactaataggtaggtaaccgttaccttcttttctttcttcggtacgtacggtaccggaaccggtccgtaccgtccctacggtacgtacgaccgaccgaccgaccccacct

SEQ ID NO: 553819 - DNA, 487 bp, Homo sapiens; identical to SEQ ID NO: 543396
  misc_feature: HIJSMM301B0TO6.46.26.C04.1.454.light.4.raw

SEQ ID NO: 553820 - DNA, 490 bp, Homo sapiens; identical to SEQ ID NO: 538273
  misc_feature: HIJSMM301EHF8I.16.73.G07.1.454.light.4.raw

SEQ ID NO: 553821 - DNA, 498 bp, Homo sapiens
  misc_feature: HIJSMM301B093I.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 553822 - DNA, 486 bp, Homo sapiens; identical to SEQ ID NO: 537583
  misc_feature: HIJSMM301A44DT.17.25.C03.1.454.light.4.raw

SEQ ID NO: 553823 - DNA, 490 bp, Homo sapiens; identical to SEQ ID NO: 536746
  misc_feature: HIJSMM301BJFFR.17.21.B10.1.454.light.4.raw

SEQ ID NO: 553824 - DNA, 444 bp, Homo sapiens; identical to SEQ ID NO: 535027
  misc_feature: HIJSMM301DQ4BZ.8.73.G07.1.454.light.4.raw

SEQ ID NO: 553825 - DNA, 487 bp, Homo sapiens; identical to SEQ ID NO: 535358
  misc_feature: HIJSMM301A1LGR.47.70.G04.1.454.light.4.raw

SEQ ID NO: 553826 - DNA, 510 bp, Homo sapiens
  misc_feature: HIJSMM301A6ZFQ.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttcccg

SEQ ID NO: 553827 - DNA, 486 bp, Homo sapiens; identical to SEQ ID NO: 537310
  misc_feature: HIJSMM301EEIEK.15.28.C06.1.454.light.4.raw

SEQ ID NO: 553828 - DNA, 444 bp, Homo sapiens; identical to SEQ ID NO: 535192
  misc_feature: HIJSMM301EPTZ0.5.9.A09.1.454.light.4.raw

SEQ ID NO: 553829 - DNA, 493 bp, Homo sapiens; identical to SEQ ID NO: 535084
  misc_feature: HIJSMM301CADBU.47.64.F09.1.454.light.4.raw

SEQ ID NO: 553830 - DNA, 489 bp, Homo sapiens; identical to SEQ ID NO: 535139
  misc_feature: HIJSMM301EFBO7.14.55.E11.1.454.light.4.raw

SEQ ID NO: 553831 - DNA, 510 bp, Homo sapiens
  misc_feature: HIJSMM301CM64A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaacgggaccaaggtggaaagtacaaacgaacctagtggctgcaccatctgtcttcatcttcccccg

SEQ ID NO: 553832 - DNA, 494 bp, Homo sapiens
  misc_feature: HIJSMM301DK0R3.41.6.A06.1.454.light.4.raw
tctatactatcacgaccggtgctcgatttagatctactgacagggggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagatcaaacgaactgtggctgcaccatctgtcttcatcttcccg

SEQ ID NO: 553833 - DNA, 481 bp, Homo sapiens; identical to SEQ ID NO: 545581
  misc_feature: HIJSMM301AG8RN.48.19.B08.1.454.light.4.raw

SEQ ID NO: 553834 - DNA, 488 bp, Homo sapiens
  misc_feature: HIJSMM301ESDT5.17.35.D02.1.454.light.4.raw
cgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtctt

SEQ ID NO: 553835 - DNA, 500 bp, Homo sapiens; identical to SEQ ID NO: 548721
  misc_feature: HIJSMM301BN93P.14.35.D02.1.454.light.4.raw

SEQ ID NO: 553836 - DNA, 486 bp, Homo sapiens; identical to SEQ ID NO: 535458
  misc_feature: HIJSMM301D6FSA.7.75.G09.1.454.light.4.raw

SEQ ID NO: 553837 - DNA, 479 bp, Homo sapiens
  misc_feature: HIJSMM301DDO5H.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcgctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattcgccagtcctatgacaacaccctgcgtggttttgctgttcggcggcggaccg

SEQ ID NO: 553838 - DNA, 438 bp, Homo sapiens; identical to SEQ ID NO: 540814
  misc_feature: HIJSMM301BP4FB.51.78.H01.1.454.light.4.raw

SEQ ID NO: 553839 - DNA, 496 bp, Homo sapiens; identical to SEQ ID NO: 535109
  misc_feature: HIJSMM301BZXTD.16.78.H01.1.454.light.4.raw

SEQ ID NO: 553840 - DNA, 501 bp, Homo sapiens; identical to SEQ ID NO: 535746
  misc_feature: HIJSMM301A1R77.18.11.A11.1.454.light.4.raw

SEQ ID NO: 553841 - DNA, 474 bp, Homo sapiens; identical to SEQ ID NO: 544751
  misc_feature: HIJSMM301AUHNO.3.38.D05.1.454.light.4.raw

SEQ ID NO: 553842 - DNA, 504 bp, Homo sapiens
  misc_feature: HIJSMM301CIMZK.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccctccc

SEQ ID NO: 553843 - DNA, 515 bp, Homo sapiens
  misc_feature: HIJSMM301EJR7B.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtaatgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttccccg

SEQ ID NO: 553844 - DNA, 446 bp, Homo sapiens; identical to SEQ ID NO: 536106
  misc_feature: HIJSMM301CR3LW.18.9.A09.1.454.light.4.raw

SEQ ID NO: 553845 - DNA, 486 bp, Homo sapiens
  misc_feature: HIJSMM301A5BC9.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcacg

SEQ ID NO: 553846 - DNA, 501 bp, Homo sapiens
  misc_feature: HIJSMM301CUY8K.41.19.B08.1.454.light.4.raw
tctatactatcacgaccggtgctcgatttagtgagtcagtaagggggcgtggggtctcaggaggcagcgctctcgggacgtctccaccatggcctgggctctgctatccctcaccctcctcactcagggcacagggtcctgggcccagtctgtcctgactcagcctgcctccgtgactgggtctcctggacagtcgatcaccgtctcctgctctggctccagtagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccccg

SEQ ID NO: 553847 - DNA, 503 bp, Homo sapiens; identical to SEQ ID NO: 551912
  misc_feature: HIJSMM301APUHS.12.50.E06.1.454.light.4.raw

SEQ ID NO: 553848 - DNA, 490 bp, Homo sapiens; identical to SEQ ID NO: 535526
  misc_feature: HIJSMM301BI1SW.26.78.H01.1.454.light.4.raw

SEQ ID NO: 553849 - DNA, 504 bp, Homo sapiens
  misc_feature: HIJSMM301AEGRK.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcaactttcggcggagggaccgaaggtaggaggaatcaaacgaaactagtggctgcaccatctgtcttcatt

SEQ ID NO: 553850 - DNA, 471 bp, Homo sapiens
  misc_feature: HIJSMM301DTJND.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggaggaccaaggtggagatcaaacgaactgtgg

SEQ ID NO: 553851 - DNA, 465 bp, Homo sapiens
  misc_feature: HIJSMM301ENDK9.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggtcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 553852 - DNA, 504 bp, Homo sapiens
  misc_feature: HIJSMM301CZT9U.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctgtt

SEQ ID NO: 553853 - DNA, 494 bp, Homo sapiens; identical to SEQ ID NO: 534994
  misc_feature: HIJSMM301BYYZ6.27.78.H01.1.454.light.4.raw

SEQ ID NO: 553854 - DNA, 493 bp, Homo sapiens
  misc_feature: HIJSMM301CVV11.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttgggccaggggaccaacctggagatcaaatgaactgtggctgcacatctgtctt

SEQ ID NO: 553855 - DNA, 496 bp, Homo sapiens; identical to SEQ ID NO: 536033
  misc_feature: HIJSMM301CC1HY.10.79.H02.1.454.light.4.raw

SEQ ID NO: 553856 - DNA, 441 bp, Homo sapiens; identical to SEQ ID NO: 551059
  misc_feature: HIJSMM301CSNAV.11.3.A03.1.454.light.4.raw
  modified_base (423)..(423): a, c, t, g, unknown or other

SEQ ID NO: 553857 - DNA, 507 bp, Homo sapiens; identical to SEQ ID NO: 542621
  misc_feature: HIJSMM301EH3RE.4.10.A10.1.454.light.4.raw

SEQ ID NO: 553858 - DNA, 510 bp, Homo sapiens
  misc_feature: HIJSMM301C1IO1.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactcgttcccacct

SEQ ID NO: 553859 - DNA, 464 bp, Homo sapiens; identical to SEQ ID NO: 537214
  misc_feature: HIJSMM301AGLYI.18.59.F04.1.454.light.4.raw

SEQ ID NO: 553860 - DNA, 489 bp, Homo sapiens; identical to SEQ ID NO: 535139
  misc_feature: HIJSMM301EDGHQ.14.55.E11.1.454.light.4.raw

SEQ ID NO: 553861 - DNA, 497 bp, Homo sapiens; identical to SEQ ID NO: 536371
  misc_feature: HIJSMM301CZUFJ.16.78.H01.1.454.light.4.raw

SEQ ID NO: 553862 - DNA, 506 bp, Homo sapiens
  misc_feature: HIJSMM301AP1RH.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttccgcc

SEQ ID NO: 553863 - DNA, 510 bp, Homo sapiens
  misc_feature: HIJSMM301CILG6.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 553864 - DNA, 506 bp, Homo sapiens; identical to SEQ ID NO: 535404
  misc_feature: HIJSMM301BMK5B.10.88.H11.1.454.light.4.raw

SEQ ID NO: 553865 - DNA, 508 bp, Homo sapiens
  misc_feature: HIJSMM301A6ELT.51.33.C11.1.454.light.4.raw
cgatcgtatacacgaccggtgctcgatttagagtgagctcgttgggtttggggctgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaaactgtggctgcaccatctgtctt

SEQ ID NO: 553866 - DNA, 506 bp, Homo sapiens; identical to SEQ ID NO: 534969
  misc_feature: HIJSMM301B2ZEN.18.37.D04.1.454.light.4.raw

SEQ ID NO: 553867 - DNA, 497 bp, Homo sapiens
  misc_feature: HIJSMM301CTIV8.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccaggtctgacgcctaggtcagcccaaggctgccccctcggtcactctcg

SEQ ID NO: 553868 - DNA, 504 bp, Homo sapiens; identical to SEQ ID NO: 535561
  misc_feature: HIJSMM301DELTV.4.57.F02.1.454.light.4.raw

SEQ ID NO: 553869 - DNA, 496 bp, Homo sapiens
  misc_feature: HIJSMM301CJ22D.52.55.E11.1.454.light.4.raw
cgcagtacgacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 553870 - DNA, 518 bp, Homo sapiens
  misc_feature: HIJSMM301C3ZTL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaagggaccgaacggtaggaagtacgaaacgaactacgtggctggtcaccactctgtcttctactcttcccgtccact

SEQ ID NO: 553871 - DNA, 460 bp, Homo sapiens; identical to SEQ ID NO: 536053
  misc_feature: HIJSMM301CBML1.22.28.C06.1.454.light.4.raw

SEQ ID NO: 553872 - DNA, 520 bp, Homo sapiens; identical to SEQ ID NO: 538570
  misc_feature: HIJSMM301CQ1TY.27.23.C01.1.454.light.4.raw

SEQ ID NO: 553873 - DNA, 486 bp, Homo sapiens
  misc_feature: HIJSMM301C1GTS.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcgagggaccaaggtcgagatcaaacgaactgtggctgcaccatctgtctt

SEQ ID NO: 553874 - DNA, 482 bp, Homo sapiens
  misc_feature: HIJSMM301BN1UW.5.12.B01.1.454.light.4.raw
atcagacacgcacgaccggtgctcgatttagtagtgtagattccgcggggggcccactgttagggctcaggggcgtgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccaccctcctccgtgtcctgat

SEQ ID NO: 553875 - DNA, 485 bp, Homo sapiens; identical to SEQ ID NO: 538956
  misc_feature: HIJSMM301A8M5M.40.69.G03.1.454.light.4.raw

SEQ ID NO: 553876 - DNA, 495 bp, Homo sapiens
  misc_feature: HIJSMM301DVNSO.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgaatcaccttcggccaagggacacgactggagattaaacgaactgtggctgcaccatctgtctt

SEQ ID NO: 553877 - DNA, 465 bp, Homo sapiens; identical to SEQ ID NO: 538589
  misc_feature: HIJSMM301ATY4Z.12.39.D06.1.454.light.4.raw

SEQ ID NO: 553878 - DNA, 503 bp, Homo sapiens
  misc_feature: HIJSMM301E2VXB.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggacgggaccgaacggacggaggatacagacggaactagtggcgtcgcacccaatctgtcttccta

SEQ ID NO: 553879 - DNA, 501 bp, Homo sapiens; identical to SEQ ID NO: 538461
  misc_feature: HIJSMM301BA3OV.13.11.A11.1.454.light.4.raw

SEQ ID NO: 553880 - DNA, 494 bp, Homo sapiens
  misc_feature: HIJSMM301B3JYK.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctctttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggaggggaccaagctgaccgtcctgggtcagcccaaggctgccccctcggtcact

SEQ ID NO: 553881 - DNA, 489 bp, Homo sapiens; identical to SEQ ID NO: 535386
  misc_feature: HIJSMM301AWLQU.12.51.E07.1.454.light.4.raw

SEQ ID NO: 553882 - DNA, 484 bp, Homo sapiens
  misc_feature: HIJSMM301EPPHB.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtaggagaatcaaacgaactagtggctgcacc

SEQ ID NO: 553883 - DNA, 500 bp, Homo sapiens
  misc_feature: HIJSMM301EM6E8.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgcat

SEQ ID NO: 553884 - DNA, 493 bp, Homo sapiens
  misc_feature: HIJSMM301DQFHX.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgtccccccg

SEQ ID NO: 553885 - DNA, 516 bp, Homo sapiens
  misc_feature: HIJSMM301BE8JE.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctcg

SEQ ID NO: 553886 - DNA, 519 bp, Homo sapiens; identical to SEQ ID NO: 542755
  misc_feature: HIJSMM301EAFYR.41.19.B08.1.454.light.4.raw

SEQ ID NO: 553887 - DNA, 488 bp, Homo sapiens; identical to SEQ ID NO: 538017
  misc_feature: HIJSMM301EP8GG.4.59.F04.1.454.light.4.raw

SEQ ID NO: 553888 - DNA, 487 bp, Homo sapiens
  misc_feature: HIJSMM301CXQIK.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtgctgcaccatct

SEQ ID NO: 553889 - DNA, 496 bp, Homo sapiens; identical to SEQ ID NO: 535541
  misc_feature: HIJSMM301D2Q0K.3.33.C11.1.454.light.4.raw

SEQ ID NO: 553890 - DNA, 498 bp, Homo sapiens
  misc_feature: HIJSMM301ASL5G.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtccgacgggaccgaccggtggagtgtacctaagacgaacgtagtggtcgtcgcgaccaact

SEQ ID NO: 553891 - DNA, 498 bp, Homo sapiens
  misc_feature: HIJSMM301EOZJC.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 553892 - DNA, 485 bp, Homo sapiens; identical to SEQ ID NO: 536263
  misc_feature: HIJSMM301A4O5G.47.78.H01.1.454.light.4.raw

SEQ ID NO: 553893 - DNA, 484 bp, Homo sapiens; identical to SEQ ID NO: 535240
  misc_feature: HIJSMM301EQV7F.47.60.F05.1.454.light.4.raw

SEQ ID NO: 553894 - DNA, 484 bp, Homo sapiens; identical to SEQ ID NO: 535240
  misc_feature: HIJSMM301DJPVO.47.60.F05.1.454.light.4.raw

SEQ ID NO: 553895 - DNA, 480 bp, Homo sapiens; identical to SEQ ID NO: 535630
  misc_feature: HIJSMM301DV15L.40.59.F04.1.454.light.4.raw

SEQ ID NO: 553896 - DNA, 485 bp, Homo sapiens; identical to SEQ ID NO: 536576
  misc_feature: HIJSMM301A5K2K.46.35.D02.1.454.light.4.raw

SEQ ID NO: 553897 - DNA, 498 bp, Homo sapiens
  misc_feature: HIJSMM301ETUKT.41.16.B05.1.454.light.4.raw
tctatactatcacgaccggtgctcgatttagagctcacgtaagggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtacacttttggccagggaccaagctcgagatcaaacgaact

SEQ ID NO: 553898 - DNA, 497 bp, Homo sapiens
  misc_feature: HIJSMM301AJR4E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagtagtctgcaacctgaagattttgcaacttactactgtcaacagagttacagtaccccctctacttcggtcggagggaccgaacggacggagatcagacgaacgtagtggcgtgcaccactctgtcttctat

SEQ ID NO: 553899 - DNA, 498 bp, Homo sapiens
  misc_feature: HIJSMM301D6SLS.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacacttgttttcggcggagggaccaaggctgaccgtcctaggtcacgcccaaggctgccccctcggtcactctgttcccacctcctcgagtgcgtct

SEQ ID NO: 553900 - DNA, 473 bp, Homo sapiens; identical to SEQ ID NO: 541472
  misc_feature: HIJSMM301CVM6I.5.12.B01.1.454.light.4.raw

SEQ ID NO: 553901 - DNA, 496 bp, Homo sapiens; identical to SEQ ID NO: 535109
  misc_feature: HIJSMM301DF3KW.16.78.H01.1.454.light.4.raw

SEQ ID NO: 553902 - DNA, 478 bp, Homo sapiens; identical to SEQ ID NO: 535129
  misc_feature: HIJSMM301CDS50.11.11.A11.1.454.light.4.raw

SEQ ID NO: 553903 - DNA, 444 bp, Homo sapiens; identical to SEQ ID NO: 534993
  misc_feature: HIJSMM301ADG77.5.9.A09.1.454.light.4.raw

SEQ ID NO: 553904 - DNA, 485 bp, Homo sapiens; identical to SEQ ID NO: 541539
  misc_feature: HIJSMM301A10CR.3.10.A10.1.454.light.4.raw

SEQ ID NO: 553905 - DNA, 496 bp, Homo sapiens
  misc_feature: HIJSMM301DVUSF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggaggatcagaacgaactagtggcgtgcaccatctgtcttcta

SEQ ID NO: 553906 - DNA, 504 bp, Homo sapiens; identical to SEQ ID NO: 542411
  misc_feature: HIJSMM301D0MQO.9.53.E09.1.454.light.4.raw

SEQ ID NO: 553907 - DNA, 494 bp, Homo sapiens
  misc_feature: HIJSMM301C3RB1.49.66.F11.1.454.light.4.raw
agtcgagagacacgaccggtgctcgatttagtcacgcgagaaggggagagccctggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtctt

SEQ ID NO: 553908 - DNA, 509 bp, Homo sapiens; identical to SEQ ID NO: 535670
  misc_feature: HIJSMM301APHF6.47.23.C01.1.454.light.4.raw

SEQ ID NO: 553909 - DNA, 505 bp, Homo sapiens; identical to SEQ ID NO: 535503
  misc_feature: HIJSMM301BJ4TI.8.28.C06.1.454.light.4.raw

SEQ ID NO: 553910 - DNA, 508 bp, Homo sapiens
  misc_feature: HIJSMM301CZI2F.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagccc

SEQ ID NO: 553911 - DNA, 423 bp, Homo sapiens
  misc_feature: HIJSMM301CIJNB.41.12.B01.1.454.light.4.raw
tctatactatcacgaccggtgctcgatttagtagtgtagattccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 553912 - DNA, 494 bp, Homo sapiens; identical to SEQ ID NO: 534992
  misc_feature: HIJSMM301AQOFG.9.1.A01.1.454.light.4.raw

SEQ ID NO: 553913 - DNA, 515 bp, Homo sapiens
  misc_feature: HIJSMM301AFRZO.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggtttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccaccctcctcgacgtagtaca

SEQ ID NO: 553914 - DNA, 498 bp, Homo sapiens
  misc_feature: HIJSMM301D7M6F.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccgccctcctcgtatctctcg

SEQ ID NO: 553915 - DNA, 491 bp, Homo sapiens; identical to SEQ ID NO: 535294
  misc_feature: HIJSMM301AZRLS.16.68.G02.1.454.light.4.raw

SEQ ID NO: 553916 - DNA, 486 bp, Homo sapiens; identical to SEQ ID NO: 535043
  misc_feature: HIJSMM301CN35S.46.35.D02.1.454.light.4.raw

SEQ ID NO: 553917 - DNA, 492 bp, Homo sapiens
  misc_feature: HIJSMM301D7W8K.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaatgaactgtggctgcaccatctgtatt

SEQ ID NO: 553918 - DNA, 486 bp, Homo sapiens; identical to SEQ ID NO: 535043
  misc_feature: HIJSMM301BE1LN.46.35.D02.1.454.light.4.raw

SEQ ID NO: 553919 - DNA, 503 bp, Homo sapiens
  misc_feature: HIJSMM301ESMS7.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccca

SEQ ID NO: 553920 - DNA, 494 bp, Homo sapiens
  misc_feature: HIJSMM301B3MQ9.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccacctcctcgagtgcgtc

SEQ ID NO: 553921 - DNA, 497 bp, Homo sapiens
  misc_feature: HIJSMM301DLFOT.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtcactt

SEQ ID NO: 553922 - DNA, 494 bp, Homo sapiens; identical to SEQ ID NO: 551626
  misc_feature: HIJSMM301CYGPY.11.59.F04.1.454.light.4.raw

SEQ ID NO: 553923 - DNA, 486 bp, Homo sapiens
  misc_feature: HIJSMM301A7BSR.49.81.H04.1.454.light.4.raw
agtcgagagacacgaccggtgctcgatttagtagtgtagattcgcggggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtt

SEQ ID NO: 553924 - DNA, 494 bp, Homo sapiens; identical to SEQ ID NO: 534994
  misc_feature: HIJSMM301EJCA2.27.78.H01.1.454.light.4.raw

SEQ ID NO: 553925 - DNA, 484 bp, Homo sapiens
  misc_feature: HIJSMM301AQ3MK.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaacgaa

SEQ ID NO: 553926 - DNA, 494 bp, Homo sapiens
  misc_feature: HIJSMM301DBZRR.52.57.F02.1.454.light.4.raw
cgcagtacgacacgaccggtgctcgatttagctcgatatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 553927 - DNA, 497 bp, Homo sapiens
  misc_feature: HIJSMM301C9LS7.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggccctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtct

SEQ ID NO: 553928 - DNA, 486 bp, Homo sapiens
  misc_feature: HIJSMM301BM7E6.5.40.D07.1.454.light.4.raw
atcagacacgcacgaccggtgctcgatttagtgatagagcgtaacaacagagggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaa

SEQ ID NO: 553929 - DNA, 485 bp, Homo sapiens; identical to SEQ ID NO: 536040
  misc_feature: HIJSMM301C6LQ1.15.1.A01.1.454.light.4.raw

SEQ ID NO: 553930 - DNA, 490 bp, Homo sapiens; identical to SEQ ID NO: 538273
  misc_feature: HIJSMM301EQ0YU.16.73.G07.1.454.light.4.raw

SEQ ID NO: 553931 - DNA, 488 bp, Homo sapiens; identical to SEQ ID NO: 536554
  misc_feature: HIJSMM301CGOFF.26.37.D04.1.454.light.4.raw

SEQ ID NO: 553932 - DNA, 500 bp, Homo sapiens; identical to SEQ ID NO: 546095
  misc_feature: HIJSMM301D4Y4I.52.78.H01.1.454.light.4.raw

SEQ ID NO: 553933 - DNA, 507 bp, Homo sapiens; identical to SEQ ID NO: 536666
  misc_feature: HIJSMM301DLQDF.11.57.F02.1.454.light.4.raw

SEQ ID NO: 553934 - DNA, 485 bp, Homo sapiens; identical to SEQ ID NO: 536630
  misc_feature: HIJSMM301BYGLY.13.56.F01.1.454.light.4.raw

SEQ ID NO: 553935 - DNA, 512 bp, Homo sapiens
  misc_feature: HIJSMM301DOJT0.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccagaccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctggtcactctgttcccg

SEQ ID NO: 553936 - DNA, 514 bp, Homo sapiens
  misc_feature: HIJSMM301BMMKR.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccggccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctcgggaccaaggtggagatcaaacgaactgtggctgcaccatctgtcttcatcttccccg

SEQ ID NO: 553937 - DNA, 434 bp, Homo sapiens
  misc_feature: HIJSMM301D4KD1.10.38.D05.1.454.light.4.raw
catagtagtgcacgaccggtgctcgatttagtatctgatagttgggtttggggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 553938 - DNA, 508 bp, Homo sapiens
  misc_feature: HIJSMM301AEKRL.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtaggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaaactagtggctgcaccatctgtcttcatcttcccgccat

SEQ ID NO: 553939 - DNA, 498 bp, Homo sapiens
  misc_feature: HIJSMM301CTN4T.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaggattttgcagtttattactgtcagcagcgtagcaactggcctcggttcacttttggccaggggaccaagctggagatcaaacgaactgtggctgcaccatctgtcttcat

SEQ ID NO: 553940 - DNA, 487 bp, Homo sapiens; identical to SEQ ID NO: 535583
  misc_feature: HIJSMM301DTH6R.22.73.G07.1.454.light.4.raw

SEQ ID NO: 553941 - DNA, 454 bp, Homo sapiens; identical to SEQ ID NO: 535005
  misc_feature: HIJSMM301B98V2.19.86.H09.1.454.light.4.raw

SEQ ID NO: 553942 - DNA, 444 bp, Homo sapiens; identical to SEQ ID NO: 536484
  misc_feature: HIJSMM301D71JZ.8.11.A11.1.454.light.4.raw

SEQ ID NO: 553943 - DNA, 494 bp, Homo sapiens
  misc_feature: HIJSMM301BXB3W.21.27.C05.1.454.light.4.raw
  modified_base (197)..(197): a, c, t, g, unknown or other
  modified_base (360)..(360): a, c, t, g, unknown or other
tcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 553944 - DNA, 492 bp, Homo sapiens; identical to SEQ ID NO: 538644
  misc_feature: HIJSMM301DZS23.26.78.H01.1.454.light.4.raw

SEQ ID NO: 553945 - DNA, 486 bp, Homo sapiens; identical to SEQ ID NO: 535043
  misc_feature: HIJSMM301DB3N5.46.35.D02.1.454.light.4.raw

SEQ ID NO: 553946 - DNA, 492 bp, Homo sapiens; identical to SEQ ID NO: 550823
  misc_feature: HIJSMM301DWXT2.49.20.B09.1.454.light.4.raw

SEQ ID NO: 553947 - DNA, 494 bp, Homo sapiens; identical to SEQ ID NO: 534994
  misc_feature: HIJSMM301BST52.27.78.H01.1.454.light.4.raw

SEQ ID NO: 553948 - DNA, 496 bp, Homo sapiens
  misc_feature: HIJSMM301CMZIJ.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagattttgtttttatattgtcagcagtatgataactggcctctgtggacgttcggccaagggaccaaggtggatgtcaaacgaactgtggctgcaccatctgtcttcat

SEQ ID NO: 553949 - DNA, 496 bp, Homo sapiens; identical to SEQ ID NO: 535541
  misc_feature: HIJSMM301AN0VG.3.33.C11.1.454.light.4.raw

SEQ ID NO: 553950 - DNA, 493 bp, Homo sapiens; identical to SEQ ID NO: 536032
  misc_feature: HIJSMM301A2UEB.22.57.F02.1.454.light.4.raw

SEQ ID NO: 553951 - DNA, 493 bp, Homo sapiens; identical to SEQ ID NO: 535745
  misc_feature: HIJSMM301BBPH1.47.78.H01.1.454.light.4.raw

SEQ ID NO: 553952 - DNA, 488 bp, Homo sapiens; identical to SEQ ID NO: 536554
  misc_feature: HIJSMM301D9SXJ.26.37.D04.1.454.light.4.raw

SEQ ID NO: 553953 - DNA, 488 bp, Homo sapiens
  misc_feature: HIJSMM301D6C99.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgactaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactgtggctgcaccat

SEQ ID NO: 553954 - DNA, 519 bp, Homo sapiens
  misc_feature: HIJSMM301COOWX.41.19.B08.1.454.light.4.raw
tctatactatcacgaccggtgctcgatttagtgagtcagtaaggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 553955 - DNA, 487 bp, Homo sapiens; identical to SEQ ID NO: 537573
  misc_feature: HIJSMM301AVX4J.3.10.A10.1.454.light.4.raw

SEQ ID NO: 553956 - DNA, 491 bp, Homo sapiens
  misc_feature: HIJSMM301BVFAQ.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccat

SEQ ID NO: 553957 - DNA, 488 bp, Homo sapiens; identical to SEQ ID NO: 535861
  misc_feature: HIJSMM301BQQTL.14.55.E11.1.454.light.4.raw

SEQ ID NO: 553958 - DNA, 499 bp, Homo sapiens; identical to SEQ ID NO: 547044
  misc_feature: HIJSMM301ELGUA.43.71.G05.1.454.light.4.raw

SEQ ID NO: 553959 - DNA, 503 bp, Homo sapiens; identical to SEQ ID NO: 537216
  misc_feature: HIJSMM301AVIFE.3.70.G04.1.454.light.4.raw

SEQ ID NO: 553960 - DNA, 503 bp, Homo sapiens
  misc_feature: HIJSMM301EC9N7.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggagggaccaaactgaccgtctaggtcagcccaaggctgccccctcggtcactctgtt

SEQ ID NO: 553961 - DNA, 494 bp, Homo sapiens
  misc_feature: HIJSMM301BG5E0.40.71.G05.1.454.light.4.raw
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtct

SEQ ID NO: 553962 - DNA, 475 bp, Homo sapiens
  misc_feature: HIJSMM301B62JT.51.38.D05.1.454.light.4.raw
cgatcgtatacacgaccggtgctcgatttagtatctgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 553963 - DNA, 447 bp, Homo sapiens
  misc_feature: HIJSMM301ALP7O.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaacgtcaccgtcctaagtcagcccaaggccaacccctctgtcactctgttcccgccctcctccatactcgta

SEQ ID NO: 553964 - DNA, 475 bp, Homo sapiens; identical to SEQ ID NO: 537714
  misc_feature: HIJSMM301EPL8F.7.81.H04.1.454.light.4.raw

SEQ ID NO: 553965 - DNA, 495 bp, Homo sapiens; identical to SEQ ID NO: 535596
  misc_feature: HIJSMM301BQFA4.10.79.H02.1.454.light.4.raw

SEQ ID NO: 553966 - DNA, 459 bp, Homo sapiens
  misc_feature: HIJSMM301CWPS4.5.14.B03.1.454.light.4.raw
atcagacacgcacgaccggtgctcgatttagtgtgagtagttccgcgggggagtcagacccagtcaggacacagcatggacatgagggtccccgctcagctcctggggctcctgctgctctggttcccaggagacagacttactctcacttgtcgggcgagtcacgatattagtaccaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaagtggagatcaaacgaactgtggctgcaccatctgtcttcatcttcccgccatctgacgtgtctgat

SEQ ID NO: 553967 - DNA, 490 bp, Homo sapiens
  misc_feature: HIJSMM301A2W8U.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactt

SEQ ID NO: 553968 - DNA, 493 bp, Homo sapiens; identical to SEQ ID NO: 535614
  misc_feature: HIJSMM301C4XC6.9.1.A01.1.454.light.4.raw

SEQ ID NO: 553969 - DNA, 487 bp, Homo sapiens
  misc_feature: HIJSMM301D1Y54.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccaccctccctcgctacgtaga

SEQ ID NO: 553970 - DNA, 421 bp, Homo sapiens
  misc_feature: HIJSMM301D08NS.41.14.B03.1.454.light.4.raw
tctatactatcacgaccggtgctcgatttagtgtgagtagttccgcgggcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgatagtataga

SEQ ID NO: 553971 - DNA, 490 bp, Homo sapiens
  misc_feature: HIJSMM301BDRNP.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcaccatctgtt

SEQ ID NO: 553972 - DNA, 504 bp, Homo sapiens
  misc_feature: HIJSMM301D8P9B.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcagtattatagtactcctccgacgttcggccaagggaccaaggtggagattaaacgaactgtggctgcaccatctgtcttcat

SEQ ID NO: 553973 - DNA, 487 bp, Homo sapiens; identical to SEQ ID NO: 536206
  misc_feature: HIJSMM301AFHZ4.47.38.D05.1.454.light.4.raw

SEQ ID NO: 553974 - DNA, 500 bp, Homo sapiens
  misc_feature: HIJSMM301DZSSI.51.73.G07.1.454.light.4.raw
cgatcgtatacacgaccggtgctcgatttagctctacgctcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccgaaactgaccgtcctaggtcagcccaaggctgccccctcggt

SEQ ID NO: 553975 - DNA, 488 bp, Homo sapiens
  misc_feature: HIJSMM301AVW6Y.26.23.C01.1.454.light.4.raw
  modified_base (476)..(476): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggntgcaccatctgt

SEQ ID NO: 553976 - DNA, 512 bp, Homo sapiens
  misc_feature: HIJSMM301E0G31.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagcccagaggatgagtcttattattactgcatgctccatgtggggggtgccacttgggtgttcggcggagggaccaagctgaccgtccg

SEQ ID NO: 553977 - DNA, 489 bp, Homo sapiens
  misc_feature: HIJSMM301APHM9.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgtctaagacgaactagtggctgcaccat

SEQ ID NO: 553978 - DNA, 506 bp, Homo sapiens; identical to SEQ ID NO: 537290
  misc_feature: HIJSMM301DCEVT.13.11.A11.1.454.light.4.raw

SEQ ID NO: 553979 - DNA, 481 bp, Homo sapiens
  misc_feature: HIJSMM301BJUCA.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagagaa

SEQ ID NO: 553980 - DNA, 485 bp, Homo sapiens; identical to SEQ ID NO: 535880
  misc_feature: HIJSMM301D7VTN.7.75.G09.1.454.light.4.raw

SEQ ID NO: 553981 - DNA, 482 bp, Homo sapiens; identical to SEQ ID NO: 536979
  misc_feature: HIJSMM301EG9PE.16.81.H04.1.454.light.4.raw

SEQ ID NO: 553982 - DNA, 517 bp, Homo sapiens
  misc_feature: HIJSMM301BY4LW.48.36.D03.1.454.light.4.raw
  modified_base (474)..(474): a, c, t, g, unknown or other
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgcttgttctattttctaagtttcctttttgttcttcggaacgtggaccggacggtcnccgtccgtacggtcacgcccgaacggaccaaccccactgtcta

SEQ ID NO: 553983 - DNA, 510 bp, Homo sapiens
  misc_feature: HIJSMM301CE4Y2.40.47.E03.1.454.light.4.raw
tctagcgactcacgaccggtgctcgatttagactcgcgcacagagagaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcactctcg

SEQ ID NO: 553984 - DNA, 505 bp, Homo sapiens; identical to SEQ ID NO: 535987
  misc_feature: HIJSMM301BLF4W.18.37.D04.1.454.light.4.raw

SEQ ID NO: 553985 - DNA, 515 bp, Homo sapiens
  misc_feature: HIJSMM301CK6AD.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaaggtaggaagtacgaaacgaactagtggcgtgcaccactctgtcttctatcttcccgtcccact

SEQ ID NO: 553986 - DNA, 495 bp, Homo sapiens
  misc_feature: HIJSMM301CJ7IK.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccctcggtcactctgttcccaccctcctcgagtgcgtct

SEQ ID NO: 553987 - DNA, 454 bp, Homo sapiens; identical to SEQ ID NO: 534964
  misc_feature: HIJSMM301DQ1X9.19.86.H09.1.454.light.4.raw

SEQ ID NO: 553988 - DNA, 486 bp, Homo sapiens; identical to SEQ ID NO: 535043
  misc_feature: HIJSMM301D5NHC.46.35.D02.1.454.light.4.raw

SEQ ID NO: 553989 - DNA, 477 bp, Homo sapiens
  misc_feature: HIJSMM301AMXNS.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgaactgtggctgcaccatctgtcttcatcttcccgccatc

SEQ ID NO: 553990 - DNA, 493 bp, Homo sapiens
  misc_feature: HIJSMM301EI3RT.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcggacgtttggtccgagggaccgaagactggagatcagacgaactgtggctgcaccatctgtcttcta

SEQ ID NO: 553991 - DNA, 444 bp, Homo sapiens; identical to SEQ ID NO: 535027
  misc_feature: HIJSMM301CL7YU.8.73.G07.1.454.light.4.raw

SEQ ID NO: 553992 - DNA, 483 bp, Homo sapiens
  misc_feature: HIJSMM301C19P1.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtggatatcagacgaa

SEQ ID NO: 553993 - DNA, 495 bp, Homo sapiens; identical to SEQ ID NO: 535964
  misc_feature: HIJSMM301DUOWG.16.10.A10.1.454.light.4.raw

SEQ ID NO: 553994 - DNA, 492 bp, Homo sapiens; identical to SEQ ID NO: 543155
  misc_feature: HIJSMM301BEO0M.10.53.E09.1.454.light.4.raw

SEQ ID NO: 553995 - DNA, 447 bp, Homo sapiens; identical to SEQ ID NO: 541921
  misc_feature: HIJSMM301DM3YN.18.9.A09.1.454.light.4.raw

SEQ ID NO: 553996 - DNA, 509 bp, Homo sapiens; identical to SEQ ID NO: 544573
  misc_feature: HIJSMM301DU9GC.10.88.H11.1.454.light.4.raw

SEQ ID NO: 553997 - DNA, 485 bp, Homo sapiens; identical to SEQ ID NO: 536263
  misc_feature: HIJSMM301EKNG3.47.78.H01.1.454.light.4.raw

SEQ ID NO: 553998 - DNA, 496 bp, Homo sapiens
  misc_feature: HIJSMM301DQVI4.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaagctgcccctcggt

SEQ ID NO: 553999 - DNA, 485 bp, Homo sapiens; identical to SEQ ID NO: 538533
  misc_feature: HIJSMM301C6AIQ.47.78.H01.1.454.light.4.raw

SEQ ID NO: 554000 - DNA, 493 bp, Homo sapiens; identical to SEQ ID NO: 536289
  misc_feature: HIJSMM301AKOZ5.14.5.A05.1.454.light.4.raw

SEQ ID NO: 554001 - DNA, 492 bp, Homo sapiens
  misc_feature: HIJSMM301BHAAP.41.23.C01.1.454.light.4.raw
tctatactatcacgaccggtgctcgatttagtacacgtgattagggattgggggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttatttttgtcaacaggctaataggttccctcaaacattcggccctgggaccagagtggatttgaagcgaactgtggctgcaccatctgtcttc

SEQ ID NO: 554002 - DNA, 494 bp, Homo sapiens
  misc_feature: HIJSMM301AGM00.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaggtggagatcaaacgaactgtggctgcaccatctgtctt

SEQ ID NO: 554003 - DNA, 490 bp, Homo sapiens; identical to SEQ ID NO: 535853
  misc_feature: HIJSMM301A33E9.22.65.F10.1.454.light.4.raw

SEQ ID NO: 554004 - DNA, 508 bp, Homo sapiens
  misc_feature: HIJSMM301AXHRH.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccc

SEQ ID NO: 554005 - DNA, 511 bp, Homo sapiens; identical to SEQ ID NO: 541549
  misc_feature: HIJSMM301EKEEP.40.33.C11.1.454.light.4.raw

SEQ ID NO: 554006 - DNA, 444 bp, Homo sapiens; identical to SEQ ID NO: 535192
  misc_feature: HIJSMM301DZRTC.5.9.A09.1.454.light.4.raw

SEQ ID NO: 554007 - DNA, 492 bp, Homo sapiens; identical to SEQ ID NO: 535939
  misc_feature: HIJSMM301AY98L.13.5.A05.1.454.light.4.raw

SEQ ID NO: 554008 - DNA, 505 bp, Homo sapiens
  misc_feature: HIJSMM301AKFEA.43.24.C02.1.454.light.4.raw
tgtgagtagtcacgaccggtgctcgatttagtacagatcgttagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaaggtcaccgtcctaggtcagcccaaggccaacccca

SEQ ID NO: 554009 - DNA, 491 bp, Homo sapiens; identical to SEQ ID NO: 535176
  misc_feature: HIJSMM301BPKOD.13.39.D06.1.454.light.4.raw

SEQ ID NO: 554010 - DNA, 423 bp, Homo sapiens
  misc_feature: HIJSMM301AK3N0.41.12.B01.1.454.light.4.raw
tctatactatcacgaccggtgctcgatttagtagtgtagattccgcgggcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 554011 - DNA, 478 bp, Homo sapiens; identical to SEQ ID NO: 544059
  misc_feature: HIJSMM301CM9DQ.40.59.F04.1.454.light.4.raw

SEQ ID NO: 554012 - DNA, 486 bp, Homo sapiens; identical to SEQ ID NO: 539294
  misc_feature: HIJSMM301BUEJF.12.33.C11.1.454.light.4.raw

SEQ ID NO: 554013 - DNA, 474 bp, Homo sapiens; identical to SEQ ID NO: 538184
  misc_feature: HIJSMM301BIS60.13.76.G10.1.454.light.4.raw

SEQ ID NO: 554014 - DNA, 488 bp, Homo sapiens; identical to SEQ ID NO: 543022
  misc_feature: HIJSMM301EERTT.9.59.F04.1.454.light.4.raw

SEQ ID NO: 554015 - DNA, 495 bp, Homo sapiens; identical to SEQ ID NO: 535486
  misc_feature: HIJSMM301AWCUS.26.72.G06.1.454.light.4.raw

SEQ ID NO: 554016 - DNA, 548 bp, Homo sapiens
  misc_feature: HIJSMM301EY2X0.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacggtcagttgtaccggtcctaggtcagcccaaacggctcgcccccctcccggttccgacctcttcgttcccctaccccctcccctccaccttaactcctaa

SEQ ID NO: 554017 - DNA, 479 bp, Homo sapiens; identical to SEQ ID NO: 547474
  misc_feature: HIJSMM301E2S78.41.17.B06.1.454.light.4.raw

SEQ ID NO: 554018 - DNA, 476 bp, Homo sapiens
  misc_feature: HIJSMM301C8U85.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaaggtggagatcgaacgaactgtggctgcacca

SEQ ID NO: 554019 - DNA, 518 bp, Homo sapiens; identical to SEQ ID NO: 539372
  misc_feature: HIJSMM301BWR1Q.7.86.H09.1.454.light.4.raw

SEQ ID NO: 554020 - DNA, 512 bp, Homo sapiens; identical to SEQ ID NO: 541300
  misc_feature: HIJSMM301DZTIR.17.33.C11.1.454.light.4.raw

SEQ ID NO: 554021 - DNA, 486 bp, Homo sapiens
  misc_feature: HIJSMM301BLOQS.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 554022 - DNA, 497 bp, Homo sapiens
  misc_feature: HIJSMM301BIUWY.41.37.D04.1.454.light.4.raw
tctatactatcacgaccggtgctcgatttagtagcatactgttgggtttgggggcaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgaggaccaaacgaacctgtggctgcaccatctgtctt

SEQ ID NO: 554023 - DNA, 486 bp, Homo sapiens; identical to SEQ ID NO: 536261
  misc_feature: HIJSMM301EVOA9.26.55.E11.1.454.light.4.raw

SEQ ID NO: 554024 - DNA, 496 bp, Homo sapiens
  misc_feature: HIJSMM301A4EM7.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctcg

SEQ ID NO: 554025 - DNA, 486 bp, Homo sapiens; identical to SEQ ID NO: 552805
  misc_feature: HIJSMM301CZJMM.3.10.A10.1.454.light.4.raw

SEQ ID NO: 554026 - DNA, 494 bp, Homo sapiens; identical to SEQ ID NO: 534994
  misc_feature: HIJSMM301EL1GD.27.78.H01.1.454.light.4.raw

SEQ ID NO: 554027 - DNA, 487 bp, Homo sapiens
  misc_feature: HIJSMM301CXZ9T.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcgtggaccagggtcaccgtcctaggtcagcccaaggcccaaccca

SEQ ID NO: 554028 - DNA, 500 bp, Homo sapiens; identical to SEQ ID NO: 541442
  misc_feature: HIJSMM301ASSPQ.12.82.H05.1.454.light.4.raw

SEQ ID NO: 554029 - DNA, 509 bp, Homo sapiens; identical to SEQ ID NO: 553073
  misc_feature: HIJSMM301C94IJ.16.1.A01.1.454.light.4.raw

SEQ ID NO: 554030 - DNA, 462 bp, Homo sapiens; identical to SEQ ID NO: 542244
  misc_feature: HIJSMM301ATMZ9.49.73.G07.1.454.light.4.raw

SEQ ID NO: 554031 - DNA, 454 bp, Homo sapiens
  misc_feature: HIJSMM301CPBRI.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctccggtcactctgttcccgccctcctccacgagagta

SEQ ID NO: 554032 - DNA, 504 bp, Homo sapiens; identical to SEQ ID NO: 538940
  misc_feature: HIJSMM301ASXZX.2.35.D02.1.454.light.4.raw

SEQ ID NO: 554033 - DNA, 496 bp, Homo sapiens
  misc_feature: HIJSMM301CN3JP.19.71.G05.1.454.light.4.raw
tactctcgtgcacgaccggtgctcgatttagtgtcgtcgcaagagagaggggggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggtctgca

SEQ ID NO: 554034 - DNA, 485 bp, Homo sapiens
  misc_feature: HIJSMM301CFRBG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggccctgggaccaaagtggatatcaaacgaactgtggctgcaccatctgtt

SEQ ID NO: 554035 - DNA, 495 bp, Homo sapiens
  misc_feature: HIJSMM301A4VIM.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgccccctcggtcactctgtt

SEQ ID NO: 554036 - DNA, 486 bp, Homo sapiens; identical to SEQ ID NO: 535385
  misc_feature: HIJSMM301COL1C.19.71.G05.1.454.light.4.raw

SEQ ID NO: 554037 - DNA, 493 bp, Homo sapiens
  misc_feature: HIJSMM301CDT4R.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcttggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 554038 - DNA, 488 bp, Homo sapiens; identical to SEQ ID NO: 543022
  misc_feature: HIJSMM301AJMBE.9.59.F04.1.454.light.4.raw

SEQ ID NO: 554039 - DNA, 497 bp, Homo sapiens; identical to SEQ ID NO: 536371
  misc_feature: HIJSMM301C8LZ5.16.78.H01.1.454.light.4.raw

SEQ ID NO: 554040 - DNA, 484 bp, Homo sapiens
  misc_feature: HIJSMM301EIXR7.4.71.G05.1.454.light.4.raw
agcactgtagcacgaccggtgctcgatttagtgtcgtcgcaagagagaggggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacgaa

SEQ ID NO: 554041 - DNA, 490 bp, Homo sapiens
  misc_feature: HIJSMM301AIZEL.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatacaaacgaactgtggctgcaccatctgtcttcta

SEQ ID NO: 554042 - DNA, 520 bp, Homo sapiens; identical to SEQ ID NO: 546048
  misc_feature: HIJSMM301BYMNM.27.23.C01.1.454.light.4.raw

SEQ ID NO: 554043 - DNA, 484 bp, Homo sapiens; identical to SEQ ID NO: 537878
  misc_feature: HIJSMM301DZ7AY.17.34.D01.1.454.light.4.raw

SEQ ID NO: 554044 - DNA, 509 bp, Homo sapiens
  misc_feature: HIJSMM301CNVOR.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctcgggacaccagcctcgctgcttggcttttcggcggagggaccaagctgaccgtcctcgggtcagcccaaggctgccccctcggtctacc

SEQ ID NO: 554045 - DNA, 494 bp, Homo sapiens; identical to SEQ ID NO: 536974
  misc_feature: HIJSMM301BXUU4.16.86.H09.1.454.light.4.raw

SEQ ID NO: 554046 - DNA, 485 bp, Homo sapiens; identical to SEQ ID NO: 535985
  misc_feature: HIJSMM301BMG4Y.15.1.A01.1.454.light.4.raw

SEQ ID NO: 554047 - DNA, 486 bp, Homo sapiens
  misc_feature: HIJSMM301BQHAA.4.51.E07.1.454.light.4.raw
agcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctatctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagattttggagtttattactgtcagcagtataataactggcctctcactttcggcggagggaccaaggtggagatcaaacgaactgtggctgcacc

SEQ ID NO: 554048 - DNA, 491 bp, Homo sapiens; identical to SEQ ID NO: 538388
  misc_feature: HIJSMM301ATQ2D.51.81.H04.1.454.light.4.raw

SEQ ID NO: 554049 - DNA, 475 bp, Homo sapiens; identical to SEQ ID NO: 548160
  misc_feature: HIJSMM301B7EHD.52.1.A01.1.454.light.4.raw

SEQ ID NO: 554050 - DNA, 487 bp, Homo sapiens
  misc_feature: HIJSMM301A6E4R.52.44.D11.1.454.light.4.raw
cgcagtacgacacgaccggtgctcgatttagcgcagtacgaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgctctggaaccagcagtgatgttggtaactataactctgtctcctggtaccaacagcacccaggcaaacgccccccaactcataattcatgatgtcactaagcggccctcaggggtccctggtcgtttctctgcctccaagtctggcaacacggcctccctgaccatctctgggctccaggctgaggatgaggctgattattactgctgctcatatgcaggcagcaacacttatgtcttcggaactgggaccaaggtcaccgtcctaggtcagcccaac

SEQ ID NO: 554051 - DNA, 498 bp, Homo sapiens; identical to SEQ ID NO: 538749
  misc_feature: HIJSMM301D4D8S.43.34.D01.1.454.light.4.raw

SEQ ID NO: 554052 - DNA, 469 bp, Homo sapiens
  misc_feature: HIJSMM301CQ9D9.51.78.H01.1.454.light.4.raw
cgatcgtatacacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtgggtcccatcaagttcagtggcagtggatctgggacagatttcactctcaccatcagcagtgtgcgacctgaagatttgcaacttactactgtcaacagagttacagtacccctcagctcactttcggcgagggaccaaaggtggagatcaaacgaa

SEQ ID NO: 554053 - DNA, 487 bp, Homo sapiens; identical to SEQ ID NO: 548447
  misc_feature: HIJSMM301ADS0T.10.23.C01.1.454.light.4.raw

SEQ ID NO: 554054 - DNA, 505 bp, Homo sapiens
  misc_feature: HIJSMM301DCJ6F.9.53.E09.1.454.light.4.raw
tgatacgtctcacgaccggtgctcgatttagagagagtgtgttgggtttgggggggtcgacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcattttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 554055 - DNA, 507 bp, Homo sapiens
  misc_feature: HIJSMM301BXACW.47.83.H06.1.454.light.4.raw
  modified_base (453)..(453): a, c, t, g, unknown or other
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcggcggggcccaggcagatgatgagtgtgattattactgtgtgctntatatggcaggtggcggtttgggtgttcggcgggaggaccaagctgaccgttcg

SEQ ID NO: 554056 - DNA, 503 bp, Homo sapiens
  misc_feature: HIJSMM301CB7VG.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaacgaactgtggctgcaccatctgtcttcatcttcccgccta

SEQ ID NO: 554057 - DNA, 486 bp, Homo sapiens; identical to SEQ ID NO: 535523
  misc_feature: HIJSMM301EKLZS.22.73.G07.1.454.light.4.raw

SEQ ID NO: 554058 - DNA, 489 bp, Homo sapiens
  misc_feature: HIJSMM301C652W.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaaa

SEQ ID NO: 554059 - DNA, 509 bp, Homo sapiens; identical to SEQ ID NO: 537697
  misc_feature: HIJSMM301BSWBY.19.59.F04.1.454.light.4.raw

SEQ ID NO: 554060 - DNA, 514 bp, Homo sapiens; identical to SEQ ID NO: 541502
  misc_feature: HIJSMM301C85AE.15.34.D01.1.454.light.4.raw

SEQ ID NO: 554061 - DNA, 486 bp, Homo sapiens; identical to SEQ ID NO: 535523
  misc_feature: HIJSMM301EFRAL.22.73.G07.1.454.light.4.raw

SEQ ID NO: 554062 - DNA, 483 bp, Homo sapiens
  misc_feature: HIJSMM301B661U.17.1.A01.1.454.light.4.raw
cgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaactagggagagcccctaaactcctgatctatgctgcatccagtttgcagactggggtcccatcaaggttcagcggcagtggatctggcacagatttcactctcaccatcagcagcctgcagcctgaagattttgcaacttattactgtctacaagattacgattaccctcggacgtcggtccaaggaccgaacggtaggagagtcaacgaactagtggcgtgcgaccactctcg

SEQ ID NO: 554063 - DNA, 485 bp, Homo sapiens; identical to SEQ ID NO: 535501
  misc_feature: HIJSMM301D8B5I.3.10.A10.1.454.light.4.raw

SEQ ID NO: 554064 - DNA, 487 bp, Homo sapiens
  misc_feature: HIJSMM301CXU5B.17.25.C03.1.454.light.4.raw
cgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 554065 - DNA, 487 bp, Homo sapiens
  misc_feature: HIJSMM301AG2K0.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggtccctcgggaccgaatagtggagtatacaaacgaaactagtggctgcaccatct

SEQ ID NO: 554066 - DNA, 489 bp, Homo sapiens; identical to SEQ ID NO: 536013
  misc_feature: HIJSMM301D4H5V.26.23.C01.1.454.light.4.raw

SEQ ID NO: 554067 - DNA, 495 bp, Homo sapiens; identical to SEQ ID NO: 535596
  misc_feature: HIJSMM301EKQX3.10.79.H02.1.454.light.4.raw

SEQ ID NO: 554068 - DNA, 509 bp, Homo sapiens; identical to SEQ ID NO: 553073
  misc_feature: HIJSMM301C2UA9.16.1.A01.1.454.light.4.raw

SEQ ID NO: 554069 - DNA, 471 bp, Homo sapiens
  misc_feature: HIJSMM301BC09A.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcgaccaagggaccaaggtggaaatcaaacgaactagt

SEQ ID NO: 554070 - DNA, 506 bp, Homo sapiens
  misc_feature: HIJSMM301C26WC.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 554071 - DNA, 496 bp, Homo sapiens
  misc_feature: HIJSMM301BZA5M.16.78.H01.1.454.light.4.raw
  modified_base (199)..(199): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcacatctgtt

SEQ ID NO: 554072 - DNA, 489 bp, Homo sapiens; identical to SEQ ID NO: 546186
  misc_feature: HIJSMM301DNQ07.52.85.H08.1.454.light.4.raw

SEQ ID NO: 554073 - DNA, 509 bp, Homo sapiens; identical to SEQ ID NO: 544573
  misc_feature: HIJSMM301A3NQZ.10.88.H11.1.454.light.4.raw

SEQ ID NO: 554074 - DNA, 514 bp, Homo sapiens
  misc_feature: HIJSMM301CH0X2.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctggtcactctcgttcccccctctccacta

SEQ ID NO: 554075 - DNA, 495 bp, Homo sapiens; identical to SEQ ID NO: 547042
  misc_feature: HIJSMM301AQ6B0.51.59.F04.1.454.light.4.raw

SEQ ID NO: 554076 - DNA, 486 bp, Homo sapiens
  misc_feature: HIJSMM301EUDG2.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaaacctgcaccctgaagatgttggaagttattactgtcagacctatagtggtggcccgctcattttcggcggagggaccaaggtgcagatcaaacgaactgtggctgcaa

SEQ ID NO: 554077 - DNA, 508 bp, Homo sapiens
  misc_feature: HIJSMM301EOCPL.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgactcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcacg

SEQ ID NO: 554078 - DNA, 509 bp, Homo sapiens; identical to SEQ ID NO: 539359
  misc_feature: HIJSMM301DIDG1.47.85.H08.1.454.light.4.raw

SEQ ID NO: 554079 - DNA, 488 bp, Homo sapiens; identical to SEQ ID NO: 535861
  misc_feature: HIJSMM301EGFWW.14.55.E11.1.454.light.4.raw

SEQ ID NO: 554080 - DNA, 495 bp, Homo sapiens; identical to SEQ ID NO: 535143
  misc_feature: HIJSMM301AQ0DW.51.29.C07.1.454.light.4.raw

SEQ ID NO: 554081 - DNA, 492 bp, Homo sapiens
  misc_feature: HIJSMM301CRWFB.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggcgtgaggatgttggcatttattactgcatgcaggctatacaccttcctcgccacttttggcctacggggaccaagctggagatcaggcgtaacg

SEQ ID NO: 554082 - DNA, 490 bp, Homo sapiens
  misc_feature: HIJSMM301EVTXL.52.33.C11.1.454.light.4.raw
cgcagtacgacacgaccggtgctcgatttagagtgagctcgttgggtttggggtggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctgccccctcggtcta

SEQ ID NO: 554083 - DNA, 486 bp, Homo sapiens; identical to SEQ ID NO: 535043
  misc_feature: HIJSMM301DS59N.46.35.D02.1.454.light.4.raw

SEQ ID NO: 554084 - DNA, 465 bp, Homo sapiens; identical to SEQ ID NO: 538589
  misc_feature: HIJSMM301AZ3OT.12.39.D06.1.454.light.4.raw

SEQ ID NO: 554085 - DNA, 454 bp, Homo sapiens; identical to SEQ ID NO: 535005
  misc_feature: HIJSMM301DSHO5.19.86.H09.1.454.light.4.raw

SEQ ID NO: 554086 - DNA, 483 bp, Homo sapiens; identical to SEQ ID NO: 542200
  misc_feature: HIJSMM301D262E.7.75.G09.1.454.light.4.raw

SEQ ID NO: 554087 - DNA, 495 bp, Homo sapiens
  misc_feature: HIJSMM301DV8W7.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtattttgtcagcagtatggcacatcaccggtcaccttcggccaagggtcacggctggagattaaacgaactgtggctgcaccatctgtcttcatcttcccgccatctgactac

SEQ ID NO: 554088 - DNA, 492 bp, Homo sapiens
  misc_feature: HIJSMM301BMI4U.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaacggtggatctcaaaagaaactgtggctgcacca

SEQ ID NO: 554089 - DNA, 483 bp, Homo sapiens
  misc_feature: HIJSMM301EU6SR.26.60.F05.1.454.light.4.raw
agactatactcacgaccggtgctcgatttagtacgtcatcagggaaagggggaggaactgctcattaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 554090 - DNA, 498 bp, Homo sapiens
  misc_feature: HIJSMM301CZVUM.21.38.D05.1.454.light.4.raw
tcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcat

SEQ ID NO: 554091 - DNA, 481 bp, Homo sapiens
  misc_feature: HIJSMM301BER8B.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaactagtggctgcaca

SEQ ID NO: 554092 - DNA, 444 bp, Homo sapiens; identical to SEQ ID NO: 534993
  misc_feature: HIJSMM301DC8SV.5.9.A09.1.454.light.4.raw

SEQ ID NO: 554093 - DNA, 462 bp, Homo sapiens
  misc_feature: HIJSMM301BICVV.40.2.A02.1.454.light.4.raw
tctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattacctcggacttttggccaggggacctggctggaggatcaaacgaa

SEQ ID NO: 554094 - DNA, 517 bp, Homo sapiens
  misc_feature: HIJSMM301D5IDM.41.19.B08.1.454.light.4.raw
tctatactatcacgaccggtgctcgatttagtgagtcagtaagggggcgtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacacccggcgaagccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgcctcct

SEQ ID NO: 554095 - DNA, 445 bp, Homo sapiens; identical to SEQ ID NO: 551271
  misc_feature: HIJSMM301AR30G.5.9.A09.1.454.light.4.raw

SEQ ID NO: 554096 - DNA, 498 bp, Homo sapiens; identical to SEQ ID NO: 552251
  misc_feature: HIJSMM301ENQ1X.7.5.A05.1.454.light.4.raw

SEQ ID NO: 554097 - DNA, 483 bp, Homo sapiens
  misc_feature: HIJSMM301C2VUV.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagttccctttaatcttcggccaagggacacgactggagattaaacgaactgtggctgcacc

SEQ ID NO: 554098 - DNA, 472 bp, Homo sapiens; identical to SEQ ID NO: 541249
  misc_feature: HIJSMM301DM65C.5.28.C06.1.454.light.4.raw

SEQ ID NO: 554099 - DNA, 503 bp, Homo sapiens; identical to SEQ ID NO: 536834
  misc_feature: HIJSMM301CH07C.2.35.D02.1.454.light.4.raw

SEQ ID NO: 554100 - DNA, 506 bp, Homo sapiens
  misc_feature: HIJSMM301BJISX.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccagggaccgacacgtagaaatagagagaactgtggcgtgcgaccatcctgtcttctatcttcccgt

SEQ ID NO: 554101 - DNA, 496 bp, Homo sapiens
  misc_feature: HIJSMM301BOIXK.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccaaggtgaccgtcctaggtcagcccaaggcc

SEQ ID NO: 554102 - DNA, 499 bp, Homo sapiens
  misc_feature: HIJSMM301APNVI.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttggaactgggaccaaggtcaccgtctaggtcagcccaaggccaaccc

SEQ ID NO: 554103 - DNA, 484 bp, Homo sapiens; identical to SEQ ID NO: 537878
  misc_feature: HIJSMM301DWHB3.17.34.D01.1.454.light.4.raw

SEQ ID NO: 554104 - DNA, 479 bp, Homo sapiens; identical to SEQ ID NO: 537141
  misc_feature: HIJSMM301BN1GQ.7.76.G10.1.454.light.4.raw

SEQ ID NO: 554105 - DNA, 498 bp, Homo sapiens; identical to SEQ ID NO: 535295
  misc_feature: HIJSMM301D5A6H.15.25.C03.1.454.light.4.raw

SEQ ID NO: 554106 - DNA, 476 bp, Homo sapiens
  misc_feature: HIJSMM301D1ZNR.41.8.A08.1.454.light.4.raw
tctatactatcacgaccggtgctcgatttagcatactctacaggggaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaacgaactgtggctgcacc

SEQ ID NO: 554107 - DNA, 484 bp, Homo sapiens; identical to SEQ ID NO: 540581
  misc_feature: HIJSMM301AGKVE.3.88.H11.1.454.light.4.raw

SEQ ID NO: 554108 - DNA, 519 bp, Homo sapiens
  misc_feature: HIJSMM301D2BOL.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttccccaccctccctcacta

SEQ ID NO: 554109 - DNA, 492 bp, Homo sapiens
  misc_feature: HIJSMM301AHLHK.49.78.H01.1.454.light.4.raw
agtcgagagacacgaccggtgctcgatttagtgtgagtagtttgggtttggggaggaatcagtcccactcaggacacagcatggacatgagggtccccgctcagctcctggggctcctgctgctctggttcccaggtgccaggtgtggcatccaggtgacccagtctccatcctccctgtctgcatctgtaggagacagagtcaccatcacctgccgggcaagtcaggacattagaaacgatttaggctggtatcagcagaaagcagggcaagcccctaagcgcctgatctatggtgcagccagtttgcacggtggggtcccatcaagattcagcggcagtggatctgggacagaattcactctcacaatcagcagcctgcagcctgaagtattttgcaacttattactgtctacagcataatagtaacccttggacgttcggaccgaacgggaccgagggtaggaaagtacaaacgaactgtggctgcacc

SEQ ID NO: 554110 - DNA, 508 bp, Homo sapiens
  misc_feature: HIJSMM301EOPOS.15.59.F04.1.454.light.4.raw
tctacgtagccacgaccggtgctcgatttagtacacacacttagggattggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcattttcggtcttcggcggagggaccaagctgaccgtcctaggtcagcccaaggctgccccctcggt

SEQ ID NO: 554111 - DNA, 505 bp, Homo sapiens; identical to SEQ ID NO: 538422
  misc_feature: HIJSMM301CZEQC.19.78.H01.1.454.light.4.raw

SEQ ID NO: 554112 - DNA, 476 bp, Homo sapiens
  misc_feature: HIJSMM301BVPQ4.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcgccgagggaccgaagtaggatgtcaaccgaactgtggctgcacca

SEQ ID NO: 554113 - DNA, 522 bp, Homo sapiens; identical to SEQ ID NO: 543352
  misc_feature: HIJSMM301C2RSC.27.23.C01.1.454.light.4.raw

SEQ ID NO: 554114 - DNA, 484 bp, Homo sapiens; identical to SEQ ID NO: 537891
  misc_feature: HIJSMM301C3I4N.10.1.A01.1.454.light.4.raw

SEQ ID NO: 554115 - DNA, 490 bp, Homo sapiens; identical to SEQ ID NO: 546232
  misc_feature: HIJSMM301DOMPG.51.28.C06.1.454.light.4.raw

SEQ ID NO: 554116 - DNA, 509 bp, Homo sapiens; identical to SEQ ID NO: 547302
  misc_feature: HIJSMM301AU3T1.4.57.F02.1.454.light.4.raw

SEQ ID NO: 554117 - DNA, 441 bp, Homo sapiens; identical to SEQ ID NO: 535074
  misc_feature: HIJSMM301EQAKH.11.3.A03.1.454.light.4.raw

SEQ ID NO: 554118 - DNA, 486 bp, Homo sapiens; identical to SEQ ID NO: 537617
  misc_feature: HIJSMM301AQWWI.10.53.E09.1.454.light.4.raw

SEQ ID NO: 554119 - DNA, 489 bp, Homo sapiens; identical to SEQ ID NO: 536013
  misc_feature: HIJSMM301AH21O.26.23.C01.1.454.light.4.raw

SEQ ID NO: 554120 - DNA, 504 bp, Homo sapiens; identical to SEQ ID NO: 553614
  misc_feature: HIJSMM301AP7TJ.7.71.G05.1.454.light.4.raw

SEQ ID NO: 554121 - DNA, 491 bp, Homo sapiens; identical to SEQ ID NO: 535294
  misc_feature: HIJSMM301ANQQO.16.68.G02.1.454.light.4.raw

SEQ ID NO: 554122 - DNA, 502 bp, Homo sapiens
  misc_feature: HIJSMM301DJYOP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtcctgggtcagcccaaggctgccccctcggtca

SEQ ID NO: 554123 - DNA, 483 bp, Homo sapiens; identical to SEQ ID NO: 536697
  misc_feature: HIJSMM301APSLZ.46.26.C04.1.454.light.4.raw

SEQ ID NO: 554124 - DNA, 504 bp, Homo sapiens
  misc_feature: HIJSMM301BW5JJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatacaaacgaactgtggctgcaccatctgtcttcatcttccccg

SEQ ID NO: 554125 - DNA, 488 bp, Homo sapiens
  misc_feature: HIJSMM301B5GUO.53.34.D01.1.454.light.4.raw
cgcgtatacacacgaccggtgctcgatttagatcgtctgtgttgggtttggggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtgggacagcaaccctgattgggtgttcggcggagggaccaaactgaccgtcctaggtcagcccaaggctgccccctc

SEQ ID NO: 554126 - DNA, 487 bp, Homo sapiens; identical to SEQ ID NO: 536206
  misc_feature: HIJSMM301C5M2M.47.38.D05.1.454.light.4.raw

SEQ ID NO: 554127 - DNA, 488 bp, Homo sapiens
  misc_feature: HIJSMM301BP8FM.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactgtggctgcaccatct

SEQ ID NO: 554128 - DNA, 494 bp, Homo sapiens; identical to SEQ ID NO: 534994
  misc_feature: HIJSMM301EHTIQ.27.78.H01.1.454.light.4.raw

SEQ ID NO: 554129 - DNA, 510 bp, Homo sapiens
  misc_feature: HIJSMM301CO83C.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatagaaagttaagagtgatggcagccacaccaaggggacgggatccccgactcgcttcatgggctccagttctggggcgtgaccgctacctcaccatctccaacctccagtctgacgatgaggctgagtatcactgtggagagagccacacaattgatggccaagacggttgggtgttcggcggagggaccaagctgaccgtccgtaggtcacg

SEQ ID NO: 554130 - DNA, 503 bp, Homo sapiens
  misc_feature: HIJSMM301CELTX.48.81.H04.1.454.light.4.raw
agtatacatacacgaccggtgctcgatttagtagtgtagattcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccct

SEQ ID NO: 554131 - DNA, 460 bp, Homo sapiens; identical to SEQ ID NO: 536053
  misc_feature: HIJSMM301C9IU9.22.28.C06.1.454.light.4.raw

SEQ ID NO: 554132 - DNA, 494 bp, Homo sapiens; identical to SEQ ID NO: 534992
  misc_feature: HIJSMM301D2YZP.9.1.A01.1.454.light.4.raw

SEQ ID NO: 554133 - DNA, 501 bp, Homo sapiens
  misc_feature: HIJSMM301AUS8Y.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctacttcttttctcttcggaactgggaccacggtccaccgtcctaggtcagccccaaggccaaaccccca

SEQ ID NO: 554134 - DNA, 492 bp, Homo sapiens
  misc_feature: HIJSMM301AGAML.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagtattttgaagtttatttctgtctgcagtacaatcagtggcctcggacgttcgccaagggaccaaggtaggaaatcaaacgaactagtggctgcaccatctgtcttcta

SEQ ID NO: 554135 - DNA, 447 bp, Homo sapiens; identical to SEQ ID NO: 535020
  misc_feature: HIJSMM301DJAWX.18.9.A09.1.454.light.4.raw

SEQ ID NO: 554136 - DNA, 488 bp, Homo sapiens
  misc_feature: HIJSMM301AWW0J.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaaatacttatctttatgtcttcggatctgggaccagggtcaccgtcctaggtcagcccaaggccaacccca

SEQ ID NO: 554137 - DNA, 476 bp, Homo sapiens
  misc_feature: HIJSMM301C2Z1E.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcgggcgggggaccgaaggtggagatcaagcgaactgtggctgca

SEQ ID NO: 554138 - DNA, 503 bp, Homo sapiens
  misc_feature: HIJSMM301CL1YA.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatggaaggtgactaccactgttattcgacagacagcagtggtagtcagggggtcttcggcggagggacgaagctgaccgtcctgagtcagcccaaggctgccccctcggtcactctgttccccg

SEQ ID NO: 554139 - DNA, 483 bp, Homo sapiens
  misc_feature: HIJSMM301BA536.52.22.B11.1.454.light.4.raw
cgcagtacgacacgaccggtgctcgatttagacgacagctcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttcccttcaccttttcggcccttgggacccatagtggatatcaaacgaactgtggctgcaccatctgtcttt

SEQ ID NO: 554140 - DNA, 497 bp, Homo sapiens; identical to SEQ ID NO: 534982
  misc_feature: HIJSMM301DHSAR.26.80.H03.1.454.light.4.raw

SEQ ID NO: 554141 - DNA, 551 bp, Homo sapiens
  misc_feature: HIJSMM301C7DLQ.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggttagccccgtttcatcttcccgccatctgactagtctacg

SEQ ID NO: 554142 - DNA, 487 bp, Homo sapiens; identical to SEQ ID NO: 537208
  misc_feature: HIJSMM301B9IG4.3.55.E11.1.454.light.4.raw

SEQ ID NO: 554143 - DNA, 486 bp, Homo sapiens
  misc_feature: HIJSMM301DJDWK.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttaatcgggtgttcggcggagggaccaagctgaccgtcctaggtcagcccaaggctgccccctcggtca

SEQ ID NO: 554144 - DNA, 494 bp, Homo sapiens; identical to SEQ ID NO: 534992
  misc_feature: HIJSMM301DDA1G.9.1.A01.1.454.light.4.raw

SEQ ID NO: 554145 - DNA, 455 bp, Homo sapiens
  misc_feature: HIJSMM301DG0J9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctttgattattactgtgcaatctgggatgacagtgtgaacggtccggtttcggcggagggaccaagctgaccgtcctaagtcagcccaaggctgccccctcggtcactctgttcccaccctcctccacgagagta

SEQ ID NO: 554146 - DNA, 494 bp, Homo sapiens
  misc_feature: HIJSMM301EC0KW.3.14.B03.1.454.light.4.raw
agacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcactttatttctgtcagcagtataataactggcctccgtggacgttcggccgggggaccaaggtggaggatcaaacgaactgtggctgcaccatctgtctt

SEQ ID NO: 554147 - DNA, 498 bp, Homo sapiens
  misc_feature: HIJSMM301EDM3J.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctcg

SEQ ID NO: 554148 - DNA, 494 bp, Homo sapiens; identical to SEQ ID NO: 534994
  misc_feature: HIJSMM301DRXXX.27.78.H01.1.454.light.4.raw

SEQ ID NO: 554149 - DNA, 555 bp, Homo sapiens
  misc_feature: HIJSMM301ASNUR.15.78.H01.1.454.light.4.raw
  modified_base (540)..(540): a, c, t, g, unknown or other
tctacgtagccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcggggctttcgacccgacgtttactcgttacttatgtcagcattcgcacttctgatacctccagcatgcctcacagcacaccttcacaggcttacagaacgctccctacccaacaacgcataagctcgctgccgcagcttcggtgcatggtttagccccgtttcatcttcccgccntctgagctacgtaga

SEQ ID NO: 554150 - DNA, 513 bp, Homo sapiens; identical to SEQ ID NO: 541387
  misc_feature: HIJSMM301EPU7O.17.33.C11.1.454.light.4.raw

SEQ ID NO: 554151 - DNA, 476 bp, Homo sapiens; identical to SEQ ID NO: 537368
  misc_feature: HIJSMM301DKWFT.7.83.H06.1.454.light.4.raw

SEQ ID NO: 554152 - DNA, 486 bp, Homo sapiens; identical to SEQ ID NO: 552805
  misc_feature: HIJSMM301EHAQQ.3.10.A10.1.454.light.4.raw

SEQ ID NO: 554153 - DNA, 478 bp, Homo sapiens
  misc_feature: HIJSMM301EXHM2.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaaggaccaaggtggaaatacaaacgaactagtggctgcaccat

SEQ ID NO: 554154 - DNA, 507 bp, Homo sapiens
  misc_feature: HIJSMM301DI3ZJ.5.24.C02.1.454.light.4.raw
atcagacacgcacgaccggtgctcgatttagtacagatcgttaggggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtcccatgtgatcttcggcggggggaccaagctgaccgtcctaggtcagcccaaggctgccccccg

SEQ ID NO: 554155 - DNA, 505 bp, Homo sapiens; identical to SEQ ID NO: 535503
  misc_feature: HIJSMM301D42C7.8.28.C06.1.454.light.4.raw

SEQ ID NO: 554156 - DNA, 520 bp, Homo sapiens; identical to SEQ ID NO: 535773
  misc_feature: HIJSMM301CYPM5.41.19.B08.1.454.light.4.raw

SEQ ID NO: 554157 - DNA, 487 bp, Homo sapiens; identical to SEQ ID NO: 537079
  misc_feature: HIJSMM301EFX8I.14.55.E11.1.454.light.4.raw

SEQ ID NO: 554158 - DNA, 517 bp, Homo sapiens
  misc_feature: HIJSMM301A01W7.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaacggtaggaaagtacaaacgaaacctagttgggctgcgaccaactctgtcttctatcttcccgcccta

SEQ ID NO: 554159 - DNA, 489 bp, Homo sapiens; identical to SEQ ID NO: 536013
  misc_feature: HIJSMM301BLKZO.26.23.C01.1.454.light.4.raw

SEQ ID NO: 554160 - DNA, 482 bp, Homo sapiens
  misc_feature: HIJSMM301C7XYL.49.83.H06.1.454.light.4.raw
agtcgagagacacgaccggtgctcgatttagatcacgtgcgtcgcggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccat

SEQ ID NO: 554161 - DNA, 497 bp, Homo sapiens; identical to SEQ ID NO: 535740
  misc_feature: HIJSMM301EC8LT.3.71.G05.1.454.light.4.raw

SEQ ID NO: 554162 - DNA, 447 bp, Homo sapiens; identical to SEQ ID NO: 535201
  misc_feature: HIJSMM301DLL1I.18.9.A09.1.454.light.4.raw

SEQ ID NO: 554163 - DNA, 444 bp, Homo sapiens; identical to SEQ ID NO: 537971
  misc_feature: HIJSMM301AZGFR.2.76.G10.1.454.light.4.raw

SEQ ID NO: 554164 - DNA, 495 bp, Homo sapiens
  misc_feature: HIJSMM301B5FA7.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 554165 - DNA, 491 bp, Homo sapiens
  misc_feature: HIJSMM301AZS5Q.5.64.F09.1.454.light.4.raw
atcagacacgcacgaccggtgctcgatttagcgcgtatacaaggggcagactcagtcaggacacagcatggacatgagggtccccgctcagctcctggggctcctgctgctctggctcccaggtgccaaatgtgacatccaaatgacccagtctcctgccaccctgtctgcttttgtgggagacagaatcaccatcacttgccgggccagtcagactattagtacctggttggcctggtatcagcaaaaaccagggaaagcccctcgtctcctgatctttgatgcctccagtttagaaactggggtcccatcaaggttcagcggccgtggatctgggacagaattcactctcaccgtcaacggcctgcagcctgatgattttgcaacttattactgccatcagtatagtagttttccattcaccttcggccctgggaccaagtggatctcagtcgaactgtggctgcaccatctgtcttcatcttcccgcc

SEQ ID NO: 554166 - DNA, 520 bp, Homo sapiens; identical to SEQ ID NO: 544672
  misc_feature: HIJSMM301BK9MR.27.23.C01.1.454.light.4.raw

SEQ ID NO: 554167 - DNA, 514 bp, Homo sapiens
  misc_feature: HIJSMM301AR37G.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccca

SEQ ID NO: 554168 - DNA, 473 bp, Homo sapiens; identical to SEQ ID NO: 541215
  misc_feature: HIJSMM301EDNJB.13.48.E04.1.454.light.4.raw

SEQ ID NO: 554169 - DNA, 489 bp, Homo sapiens; identical to SEQ ID NO: 535139
  misc_feature: HIJSMM301A4CGL.14.55.E11.1.454.light.4.raw

SEQ ID NO: 554170 - DNA, 478 bp, Homo sapiens; identical to SEQ ID NO: 535129
  misc_feature: HIJSMM301B54MK.11.11.A11.1.454.light.4.raw

SEQ ID NO: 554171 - DNA, 494 bp, Homo sapiens
  misc_feature: HIJSMM301BLI30.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtct

SEQ ID NO: 554172 - DNA, 486 bp, Homo sapiens
  misc_feature: HIJSMM301A8D4X.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgtaggctgaagatgtggcagtttattattgtcaacaatattattatacttcgtggacgttcggccaagggaccaaggtggatatcagacgaa

SEQ ID NO: 554173 - DNA, 506 bp, Homo sapiens
  misc_feature: HIJSMM301EA8X8.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctggctccaggctgacgacgaggctgaatattactgcagctcatatgtagatggtgcctctttctaaggttttcggcggagggaccaggctgaccgtcctaagtcagcccaaggctcgccccctcggt

SEQ ID NO: 554174 - DNA, 503 bp, Homo sapiens
  misc_feature: HIJSMM301EKWAS.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgttcccc

SEQ ID NO: 554175 - DNA, 495 bp, Homo sapiens
  misc_feature: HIJSMM301CWTLV.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatacaaacgaactgtggctgcaccatctgtcttcatcttcccgc

SEQ ID NO: 554176 - DNA, 443 bp, Homo sapiens
  misc_feature: HIJSMM301DP8EX.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttccaccctcctcagacgtatca

SEQ ID NO: 554177 - DNA, 496 bp, Homo sapiens
  misc_feature: HIJSMM301DAAUL.22.14.B03.1.454.light.4.raw
acatacgcgtcacgaccggtgctcgatttagtgtgagtagttccgcgggggagctacaacagacaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 554178 - DNA, 493 bp, Homo sapiens; identical to SEQ ID NO: 536534
  misc_feature: HIJSMM301DTT9Y.43.72.G06.1.454.light.4.raw

SEQ ID NO: 554179 - DNA, 499 bp, Homo sapiens
  misc_feature: HIJSMM301DG4KH.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtggctgcacatct

SEQ ID NO: 554180 - DNA, 495 bp, Homo sapiens
  misc_feature: HIJSMM301ENZZY.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaacgaactgtggctgcacat

SEQ ID NO: 554181 - DNA, 505 bp, Homo sapiens
  misc_feature: HIJSMM301BHB3G.52.37.D04.1.454.light.4.raw
cgcagtacgacacgaccggtgctcgatttagtagcatactgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgctagtttattactgtcagcagcgtagcaactggcctccgatcaccttcggccaagggacacgactggagaattaaacgaactgtggctgcaccatctgtcttcattccc

SEQ ID NO: 554182 - DNA, 487 bp, Homo sapiens; identical to SEQ ID NO: 536536
  misc_feature: HIJSMM301EMLYN.26.45.E01.1.454.light.4.raw

SEQ ID NO: 554183 - DNA, 493 bp, Homo sapiens; identical to SEQ ID NO: 535047
  misc_feature: HIJSMM301EJFIT.16.53.E09.1.454.light.4.raw

SEQ ID NO: 554184 - DNA, 453 bp, Homo sapiens
  misc_feature: HIJSMM301BTY0Y.19.71.G05.1.454.light.4.raw
tactctcgtgcacgaccggtgctcgatttagtgtcgtcgcaagagagaggggcacttctccctctaacactctccccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 554185 - DNA, 486 bp, Homo sapiens; identical to SEQ ID NO: 535043
  misc_feature: HIJSMM301ANJTP.46.35.D02.1.454.light.4.raw

SEQ ID NO: 554186 - DNA, 447 bp, Homo sapiens; identical to SEQ ID NO: 535201
  misc_feature: HIJSMM301EG7HS.18.9.A09.1.454.light.4.raw

SEQ ID NO: 554187 - DNA, 496 bp, Homo sapiens; identical to SEQ ID NO: 535541
  misc_feature: HIJSMM301CRO3L.3.33.C11.1.454.light.4.raw

SEQ ID NO: 554188 - DNA, 460 bp, Homo sapiens
  misc_feature: HIJSMM301AIBU3.41.6.A06.1.454.light.4.raw
tctatactatcacgaccggtgctcgatttagatctactgacagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaatagtataga

SEQ ID NO: 554189 - DNA, 506 bp, Homo sapiens
  misc_feature: HIJSMM301AWM81.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 554190 - DNA, 494 bp, Homo sapiens
  misc_feature: HIJSMM301BFJ0S.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggaccaacttttagatgaggccgactatttctgtcacacgtgggacatgggcactgcgatcttcggcggagggaccaagctgaccgtcctgggtcagcccaaggctgccccctcggtcactc

SEQ ID NO: 554191 - DNA, 513 bp, Homo sapiens
  misc_feature: HIJSMM301CAW4U.43.19.B08.1.454.light.4.raw
  modified_base (436)..(436): a, c, t, g, unknown or other
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcaggtcgaagccggggatgaggccgactattactgtcaggtgtgggataatggtggtgatcatccggtnttcggcggaggaccaagttgaccgtcctaagtcagcccaaggctcgccccctcggtcactctgttccccaccctcct

SEQ ID NO: 554192 - DNA, 490 bp, Homo sapiens; identical to SEQ ID NO: 543909
  misc_feature: HIJSMM301A3J5O.14.55.E11.1.454.light.4.raw

SEQ ID NO: 554193 - DNA, 523 bp, Homo sapiens
  misc_feature: HIJSMM301EGRZN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaacgaaactacgtggcgtgcaccactctgtcttctactcttcccgtcccact

SEQ ID NO: 554194 - DNA, 491 bp, Homo sapiens; identical to SEQ ID NO: 538021
  misc_feature: HIJSMM301BCFHZ.3.72.G06.1.454.light.4.raw

SEQ ID NO: 554195 - DNA, 469 bp, Homo sapiens
  misc_feature: HIJSMM301AO2JR.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgtggctgca

SEQ ID NO: 554196 - DNA, 494 bp, Homo sapiens; identical to SEQ ID NO: 534992
  misc_feature: HIJSMM301BRJ5L.9.1.A01.1.454.light.4.raw

SEQ ID NO: 554197 - DNA, 502 bp, Homo sapiens
  misc_feature: HIJSMM301DV34K.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgtcctgccctcctcta

SEQ ID NO: 554198 - DNA, 495 bp, Homo sapiens
  misc_feature: HIJSMM301DJ12W.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaa

SEQ ID NO: 554199 - DNA, 492 bp, Homo sapiens; identical to SEQ ID NO: 535126
  misc_feature: HIJSMM301CZP7O.18.11.A11.1.454.light.4.raw

SEQ ID NO: 554200 - DNA, 503 bp, Homo sapiens; identical to SEQ ID NO: 536760
  misc_feature: HIJSMM301B9VDX.47.55.E11.1.454.light.4.raw

SEQ ID NO: 554201 - DNA, 515 bp, Homo sapiens
  misc_feature: HIJSMM301DKBN6.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctggtcactctgttcccg

SEQ ID NO: 554202 - DNA, 504 bp, Homo sapiens; identical to SEQ ID NO: 535935
  misc_feature: HIJSMM301DDIWY.18.78.H01.1.454.light.4.raw

SEQ ID NO: 554203 - DNA, 494 bp, Homo sapiens; identical to SEQ ID NO: 534994
  misc_feature: HIJSMM301BNPOC.27.78.H01.1.454.light.4.raw

SEQ ID NO: 554204 - DNA, 503 bp, Homo sapiens; identical to SEQ ID NO: 538884
  misc_feature: HIJSMM301CXUH9.27.78.H01.1.454.light.4.raw

SEQ ID NO: 554205 - DNA, 484 bp, Homo sapiens; identical to SEQ ID NO: 535400
  misc_feature: HIJSMM301EW2PA.46.26.C04.1.454.light.4.raw

SEQ ID NO: 554206 - DNA, 484 bp, Homo sapiens; identical to SEQ ID NO: 535211
  misc_feature: HIJSMM301DGCXB.47.46.E02.1.454.light.4.raw

SEQ ID NO: 554207 - DNA, 486 bp, Homo sapiens; identical to SEQ ID NO: 538674
  misc_feature: HIJSMM301C0N8T.47.38.D05.1.454.light.4.raw

SEQ ID NO: 554208 - DNA, 508 bp, Homo sapiens
  misc_feature: HIJSMM301DWEWG.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagccaaggccaaccccactgtcactctgttccca

SEQ ID NO: 554209 - DNA, 487 bp, Homo sapiens
  misc_feature: HIJSMM301BFNUR.4.4.A04.1.454.light.4.raw
agcactgtagcacgaccggtgctcgatttagagtagtgatcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataataagtttttggacgttcggccaggggaccgaaggtcgaaatagagacgaactgtggctgcaccatctgtcttcta

SEQ ID NO: 554210 - DNA, 486 bp, Homo sapiens
  misc_feature: HIJSMM301B6B17.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaagtggatatcagacgaa

SEQ ID NO: 554211 - DNA, 502 bp, Homo sapiens
  misc_feature: HIJSMM301BWMO9.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgcctcctcta

SEQ ID NO: 554212 - DNA, 494 bp, Homo sapiens
  misc_feature: HIJSMM301BXRMG.43.16.B05.1.454.light.4.raw
tgtgagtagtcacgaccggtgctcgatttagagctcacgtaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactgggtcccatcaaggttcagtggcagtggatctggggcagatttcactctcaacatcggcagtgttcaacctgaagattttgcgacttattattgtcaacagagtcacagtttcccgtacacttttggccaggggaccaggctggagagcaaacgaactgtggctgcaccatctgtcttcatcttccccg

SEQ ID NO: 554213 - DNA, 493 bp, Homo sapiens
  misc_feature: HIJSMM301CDPF1.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccaaagtaggacatcaagcgaactcgtggctgcaccactctgtt

SEQ ID NO: 554214 - DNA, 488 bp, Homo sapiens; identical to SEQ ID NO: 537124
  misc_feature: HIJSMM301AUCEY.11.25.C03.1.454.light.4.raw

SEQ ID NO: 554215 - DNA, 503 bp, Homo sapiens; identical to SEQ ID NO: 543816
  misc_feature: HIJSMM301BZKWW.5.86.H09.1.454.light.4.raw

SEQ ID NO: 554216 - DNA, 508 bp, Homo sapiens
  misc_feature: HIJSMM301BWB4A.13.11.A11.1.454.light.4.raw
tcacgtactacacgaccggtgctcgatttagctacgactgcgggtaaggaagggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccccactgtcactctgttccccc

SEQ ID NO: 554217 - DNA, 506 bp, Homo sapiens; identical to SEQ ID NO: 535058
  misc_feature: HIJSMM301A03F5.17.41.D08.1.454.light.4.raw

SEQ ID NO: 554218 - DNA, 489 bp, Homo sapiens; identical to SEQ ID NO: 535139
  misc_feature: HIJSMM301C98Q5.14.55.E11.1.454.light.4.raw

SEQ ID NO: 554219 - DNA, 490 bp, Homo sapiens; identical to SEQ ID NO: 535420
  misc_feature: HIJSMM301CWS52.3.72.G06.1.454.light.4.raw

SEQ ID NO: 554220 - DNA, 497 bp, Homo sapiens; identical to SEQ ID NO: 535286
  misc_feature: HIJSMM301BYYAF.18.59.F04.1.454.light.4.raw

SEQ ID NO: 554221 - DNA, 493 bp, Homo sapiens
  misc_feature: HIJSMM301C1CQX.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggatttgcagtgtattactgtcagcagtatcataggtcaaacaccttcggccaagggacacgactggagattaaaggaactgtggctgcaccatctgtcttcatcttccccg

SEQ ID NO: 554222 - DNA, 521 bp, Homo sapiens
  misc_feature: HIJSMM301DW2ID.27.23.C01.1.454.light.4.raw
  modified_base (505)..(505): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtnactctgttcccaccct

SEQ ID NO: 554223 - DNA, 497 bp, Homo sapiens
  misc_feature: HIJSMM301DGJNO.3.33.C11.1.454.light.4.raw
  modified_base (479)..(479): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccctcggtcactctgttcccnccctcctcgagtgcgtct

SEQ ID NO: 554224 - DNA, 478 bp, Homo sapiens; identical to SEQ ID NO: 535129
  misc_feature: HIJSMM301EQIWB.11.11.A11.1.454.light.4.raw

SEQ ID NO: 554225 - DNA, 484 bp, Homo sapiens
  misc_feature: HIJSMM301AQ7FZ.49.53.E09.1.454.light.4.raw
agtcgagagacacgaccggtgctcgatttagagagagtgtgttgggtttggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacagggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccta

SEQ ID NO: 554226 - DNA, 501 bp, Homo sapiens
  misc_feature: HIJSMM301DMEDI.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaacgaactgtggctgcaccatctgtcttcatcttcccgccat

SEQ ID NO: 554227 - DNA, 528 bp, Homo sapiens
  misc_feature: HIJSMM301COOCL.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgattttacttgctgctcatatgcaggtgatcacacttttattgttcggacgtgggaccgaacggtacgaccgtccctacggtcgagcccaacggaccaacccccacctacgttcactccttcg

SEQ ID NO: 554228 - DNA, 506 bp, Homo sapiens
  misc_feature: HIJSMM301DMNYN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatcccggggtccctgaccgattcagtggcagcgggtctgggacagatttcactctcaccatcagcagcctgcaggctgaagatgtggcagtttattactgtcaacagttttctcgggcgttcgccaaggaccaaggtaggaaagtacaaacgaactacgtggctgcaccatctgtcttcatcttccccg

SEQ ID NO: 554229 - DNA, 447 bp, Homo sapiens; identical to SEQ ID NO: 535201
  misc_feature: HIJSMM301DWCVM.18.9.A09.1.454.light.4.raw

SEQ ID NO: 554230 - DNA, 475 bp, Homo sapiens
  misc_feature: HIJSMM301CI2Z4.5.15.B04.1.454.light.4.raw
atcagacacgcacgaccggtgctcgatttagacagtatatatccgcggggagtcagactcagtcaggacacagcatggacatgagggtccccgctcagctcctggggctcctgctgctctggctcccaggtgccaaatgtgacatccagatgacccagtctccttccaccctgtctgcatctacaggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcacc

SEQ ID NO: 554231 - DNA, 457 bp, Homo sapiens
  misc_feature: HIJSMM301EFNV0.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 554232 - DNA, 488 bp, Homo sapiens
  misc_feature: HIJSMM301AWBB9.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccgaaggtggagatcaaacgaactagtggctgcaccat

SEQ ID NO: 554233 - DNA, 503 bp, Homo sapiens
  misc_feature: HIJSMM301B9TJU.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 554234 - DNA, 495 bp, Homo sapiens; identical to SEQ ID NO: 538651
  misc_feature: HIJSMM301AIDUD.10.79.H02.1.454.light.4.raw

SEQ ID NO: 554235 - DNA, 490 bp, Homo sapiens
  misc_feature: HIJSMM301CO1WD.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 554236 - DNA, 510 bp, Homo sapiens
  misc_feature: HIJSMM301AQIG2.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaagtaaaattttgttattggtaccaactgaagtcaggccaggcccctgtcctggtcatttatgaggacgaccagcgaccctccaggatccctgcgaggttctctggatcgaactcagggacattggccacctttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 554237 - DNA, 495 bp, Homo sapiens
  misc_feature: HIJSMM301CH3EO.27.78.H01.1.454.light.4.raw
  modified_base (432)..(432): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcagtgancacctcgccaagggacgacgactaggagattaaacgaaactagtggcgtgcaccatctgtctt

SEQ ID NO: 554238 - DNA, 496 bp, Homo sapiens
  misc_feature: HIJSMM301EHOIP.51.86.H09.1.454.light.4.raw
cgatcgtatacacgaccggtgctcgatttagtgctatagacttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggcgtgcgattttcggcggtagggaccagtctgaccgtcctaggtcagccaaggctgccccctcggtcact

SEQ ID NO: 554239 - DNA, 506 bp, Homo sapiens
  misc_feature: HIJSMM301DWEQI.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaggcctggccagcctcccaggctcctcatttatgatacatccaccagggccactggtgtcccagccaggttcactgggcggtgggtctgggacagagttcactctcaccatcagcagcctgcagtctgaagtattttacattttattactgtcagcagtatcgtaagtggactccgacgtttggccaagggaccaaggtggaagtcaaacgaactgtggctgcaccatctgtcttcatcttcccgcc

SEQ ID NO: 554240 - DNA, 503 bp, Homo sapiens
  misc_feature: HIJSMM301BJJQE.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaatcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttccc

SEQ ID NO: 554241 - DNA, 516 bp, Homo sapiens
  misc_feature: HIJSMM301DBH1V.10.28.C06.1.454.light.4.raw
catagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctcctgaccatctctgggctccagactgaggacgaggctgattattactgcagctcacatacaagcggcagcggttgggtgttcggcgggggaccgacactgaccgtcctaggtcagccaaggctgcccctccggtcactctgttccccg

SEQ ID NO: 554242 - DNA, 509 bp, Homo sapiens
  misc_feature: HIJSMM301CJSRO.48.38.D05.1.454.light.4.raw
agtatacatacacgaccggtgctcgatttagtatctgatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgttcccgcct

SEQ ID NO: 554243 - DNA, 490 bp, Homo sapiens; identical to SEQ ID NO: 535420
  misc_feature: HIJSMM301B4E22.3.72.G06.1.454.light.4.raw

SEQ ID NO: 554244 - DNA, 490 bp, Homo sapiens; identical to SEQ ID NO: 541141
  misc_feature: HIJSMM301EX5DE.47.38.D05.1.454.light.4.raw

SEQ ID NO: 554245 - DNA, 441 bp, Homo sapiens; identical to SEQ ID NO: 534971
  misc_feature: HIJSMM301EMEG0.11.3.A03.1.454.light.4.raw

SEQ ID NO: 554246 - DNA, 475 bp, Homo sapiens; identical to SEQ ID NO: 544617
  misc_feature: HIJSMM301AXXIT.13.76.G10.1.454.light.4.raw

SEQ ID NO: 554247 - DNA, 504 bp, Homo sapiens
  misc_feature: HIJSMM301AT53X.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 554248 - DNA, 487 bp, Homo sapiens; identical to SEQ ID NO: 536179
  misc_feature: HIJSMM301BRZWU.19.57.F02.1.454.light.4.raw

SEQ ID NO: 554249 - DNA, 494 bp, Homo sapiens
  misc_feature: HIJSMM301EAU5N.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcat

SEQ ID NO: 554250 - DNA, 474 bp, Homo sapiens
  misc_feature: HIJSMM301CMSD0.4.69.G03.1.454.light.4.raw
agcactgtagcacgaccggtgctcgatttagtcgctgcgtaaaggagaaagggggcaggagtcagtctcagtcaggacacagcatggacatgagggtccccgctcagctcctggggctcctgctactctggctccgaggtgccagatgtgacatccagatgacccagtctccatcctccctgtctgcgtctgtaggtgacagcgtcaccatcacttgccgggcaagtcagagtattagtatctatttaaattggtatcagcagaaaccagggaaagtccctaagctcctgatctatggtgcattcaacttgcaaagtgggatcccatcacggttcagtggcagtggatctgggacagatttcactctcaccatcagcagtctgcaacctgaagattttgcaacttacttctgtcaccagagtcacagtacccctcacacttttggccaggggaccaacttagagatcaaacgaa

SEQ ID NO: 554251 - DNA, 493 bp, Homo sapiens; identical to SEQ ID NO: 535084
  misc_feature: HIJSMM301DHQRQ.47.64.F09.1.454.light.4.raw

SEQ ID NO: 554252 - DNA, 447 bp, Homo sapiens; identical to SEQ ID NO: 535201
  misc_feature: HIJSMM301B20BH.18.9.A09.1.454.light.4.raw

SEQ ID NO: 554253 - DNA, 507 bp, Homo sapiens; identical to SEQ ID NO: 538063
  misc_feature: HIJSMM301AQ3M9.47.85.H08.1.454.light.4.raw

SEQ ID NO: 554254 - DNA, 505 bp, Homo sapiens
  misc_feature: HIJSMM301CGCVQ.9.71.G05.1.454.light.4.raw
tgatacgtctcacgaccggtgctcgatttagtgtcgtcgcaagagagaggggggggtcgacaagaggcagcgctctcgggacggtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 554255 - DNA, 507 bp, Homo sapiens
  misc_feature: HIJSMM301CPXPQ.49.23.C01.1.454.light.4.raw
agtcgagagacacgaccggtgctcgatttagtacacgtgattagggattgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagccaaggctgccccctcggtcactctgtt

SEQ ID NO: 554256 - DNA, 504 bp, Homo sapiens; identical to SEQ ID NO: 539083
  misc_feature: HIJSMM301CP6UQ.8.19.B08.1.454.light.4.raw

SEQ ID NO: 554257 - DNA, 484 bp, Homo sapiens; identical to SEQ ID NO: 539556
  misc_feature: HIJSMM301BCGC6.22.6.A06.1.454.light.4.raw

SEQ ID NO: 554258 - DNA, 484 bp, Homo sapiens; identical to SEQ ID NO: 535240
  misc_feature: HIJSMM301CWL84.47.60.F05.1.454.light.4.raw

SEQ ID NO: 554259 - DNA, 508 bp, Homo sapiens
  misc_feature: HIJSMM301ETK7X.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgca

SEQ ID NO: 554260 - DNA, 489 bp, Homo sapiens; identical to SEQ ID NO: 535386
  misc_feature: HIJSMM301D0JX9.12.51.E07.1.454.light.4.raw

SEQ ID NO: 554261 - DNA, 491 bp, Homo sapiens
  misc_feature: HIJSMM301AR9YO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactagtggctgcaccatctgtcttcta

SEQ ID NO: 554262 - DNA, 486 bp, Homo sapiens
  misc_feature: HIJSMM301ATHYO.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcggaccaaagtggatatcaaacgaactgtggctgcaccatctgtt

SEQ ID NO: 554263 - DNA, 494 bp, Homo sapiens; identical to SEQ ID NO: 535680
  misc_feature: HIJSMM301CRIOX.16.78.H01.1.454.light.4.raw

SEQ ID NO: 554264 - DNA, 496 bp, Homo sapiens; identical to SEQ ID NO: 537225
  misc_feature: HIJSMM301AMKZG.11.59.F04.1.454.light.4.raw

SEQ ID NO: 554265 - DNA, 473 bp, Homo sapiens
  misc_feature: HIJSMM301B109G.4.76.G10.1.454.light.4.raw
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaaggaccaaggtggaaatcaaacgaactagtggctgcacc

SEQ ID NO: 554266 - DNA, 507 bp, Homo sapiens
  misc_feature: HIJSMM301AFJMX.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttggtgttcggcggagggaccaagttgaccgtcctaggtcagcccaaggctcgccccctcggtcactc

SEQ ID NO: 554267 - DNA, 491 bp, Homo sapiens; identical to SEQ ID NO: 542796
  misc_feature: HIJSMM301EZQFY.19.57.F02.1.454.light.4.raw

SEQ ID NO: 554268 - DNA, 487 bp, Homo sapiens; identical to SEQ ID NO: 536206
  misc_feature: HIJSMM301EXKKB.47.38.D05.1.454.light.4.raw

SEQ ID NO: 554269 - DNA, 497 bp, Homo sapiens; identical to SEQ ID NO: 535664
  misc_feature: HIJSMM301EYOFB.22.14.B03.1.454.light.4.raw

SEQ ID NO: 554270 - DNA, 484 bp, Homo sapiens
  misc_feature: HIJSMM301B5WFK.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagttgcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 554271 - DNA, 498 bp, Homo sapiens; identical to SEQ ID NO: 537098
  misc_feature: HIJSMM301A6YBP.12.67.G01.1.454.light.4.raw

SEQ ID NO: 554272 - DNA, 486 bp, Homo sapiens; identical to SEQ ID NO: 535043
  misc_feature: HIJSMM301CC9RA.46.35.D02.1.454.light.4.raw

SEQ ID NO: 554273 - DNA, 487 bp, Homo sapiens; identical to SEQ ID NO: 538190
  misc_feature: HIJSMM301D6WE6.47.70.G04.1.454.light.4.raw

SEQ ID NO: 554274 - DNA, 515 bp, Homo sapiens
  misc_feature: HIJSMM301AJ5YY.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggcaaggaccaaggtggcaatcaaccgaactgtggctgcaccatctgtcttcatcttcccgccatctgagacacgcgacg

SEQ ID NO: 554275 - DNA, 496 bp, Homo sapiens
  misc_feature: HIJSMM301BWS7T.18.59.F04.1.454.light.4.raw
  modified_base (452)..(452): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatntcttcggaactgggaccaaggtcaccgtcctaggtcagccaagg

SEQ ID NO: 554276 - DNA, 495 bp, Homo sapiens
  misc_feature: HIJSMM301A6VOX.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggaggaccagggtggagatcaaacgaactgtggctgcaccatctgtcttcta

SEQ ID NO: 554277 - DNA, 502 bp, Homo sapiens
  misc_feature: HIJSMM301CWFNM.19.78.H01.1.454.light.4.raw
  modified_base (496)..(496): a, c, t, g, unknown or other
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaaggccaaacccnctgtca

SEQ ID NO: 554278 - DNA, 510 bp, Homo sapiens; identical to SEQ ID NO: 535855
  misc_feature: HIJSMM301EB2PG.17.33.C11.1.454.light.4.raw

SEQ ID NO: 554279 - DNA, 493 bp, Homo sapiens; identical to SEQ ID NO: 535657
  misc_feature: HIJSMM301BCOJY.27.78.H01.1.454.light.4.raw

SEQ ID NO: 554280 - DNA, 441 bp, Homo sapiens; identical to SEQ ID NO: 534971
  misc_feature: HIJSMM301ENWQG.11.3.A03.1.454.light.4.raw

SEQ ID NO: 554281 - DNA, 520 bp, Homo sapiens; identical to SEQ ID NO: 537173
  misc_feature: HIJSMM301B7ULF.27.23.C01.1.454.light.4.raw

SEQ ID NO: 554282 - DNA, 498 bp, Homo sapiens
  misc_feature: HIJSMM301CSH41.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagattttgtttttattattgtcagcagtatgataactggcctctgtggacgttcggccaagggaccaaggtggatgtcaaacgaactgtggctgcaccatctgtcttcatt

SEQ ID NO: 554283 - DNA, 469 bp, Homo sapiens; identical to SEQ ID NO: 536091
  misc_feature: HIJSMM301BX8IQ.3.82.H05.1.454.light.4.raw

SEQ ID NO: 554284 - DNA, 487 bp, Homo sapiens; identical to SEQ ID NO: 536025
  misc_feature: HIJSMM301CZ77G.17.34.D01.1.454.light.4.raw

SEQ ID NO: 554285 - DNA, 500 bp, Homo sapiens
  misc_feature: HIJSMM301CHU7E.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttcccgccctcctccacgagagta

SEQ ID NO: 554286 - DNA, 486 bp, Homo sapiens; identical to SEQ ID NO: 535917
  misc_feature: HIJSMM301EAQ1Z.3.10.A10.1.454.light.4.raw

SEQ ID NO: 554287 - DNA, 487 bp, Homo sapiens; identical to SEQ ID NO: 535583
  misc_feature: HIJSMM301CPQY9.22.73.G07.1.454.light.4.raw

SEQ ID NO: 554288 - DNA, 494 bp, Homo sapiens; identical to SEQ ID NO: 534994
  misc_feature: HIJSMM301D27ME.27.78.H01.1.454.light.4.raw

SEQ ID NO: 554289 - DNA, 494 bp, Homo sapiens
  misc_feature: HIJSMM301DMOYJ.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttcccg

SEQ ID NO: 554290 - DNA, 504 bp, Homo sapiens
  misc_feature: HIJSMM301C75G0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcgttcggccaagggaccaaggtggaaatcaaacgaactagtggctgcaccatctgtcttcatcttccccg

SEQ ID NO: 554291 - DNA, 439 bp, Homo sapiens
  misc_feature: HIJSMM301D4Y9L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctccccatactcgta

SEQ ID NO: 554292 - DNA, 506 bp, Homo sapiens; identical to SEQ ID NO: 545155
  misc_feature: HIJSMM301CBZUU.9.12.B01.1.454.light.4.raw

SEQ ID NO: 554293 - DNA, 479 bp, Homo sapiens; identical to SEQ ID NO: 537163
  misc_feature: HIJSMM301DPG3S.13.73.G07.1.454.light.4.raw

SEQ ID NO: 554294 - DNA, 523 bp, Homo sapiens
  misc_feature: HIJSMM301BKGLG.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccacgactcataatttattgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccgccctcct

SEQ ID NO: 554295 - DNA, 441 bp, Homo sapiens; identical to SEQ ID NO: 535074
  misc_feature: HIJSMM301EPVUP.11.3.A03.1.454.light.4.raw

SEQ ID NO: 554296 - DNA, 496 bp, Homo sapiens; identical to SEQ ID NO: 537513
  misc_feature: HIJSMM301BAKAG.12.87.H10.1.454.light.4.raw

SEQ ID NO: 554297 - DNA, 512 bp, Homo sapiens
  misc_feature: HIJSMM301BLPUN.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggacaagctgaccgtcctaggtcagcccaaggctcgccccctccggtcactctcgtcccgt

SEQ ID NO: 554298 - DNA, 480 bp, Homo sapiens; identical to SEQ ID NO: 547848
  misc_feature: HIJSMM301AJ6DL.7.83.H06.1.454.light.4.raw

SEQ ID NO: 554299 - DNA, 484 bp, Homo sapiens; identical to SEQ ID NO: 535400
  misc_feature: HIJSMM301D3D05.46.26.C04.1.454.light.4.raw

SEQ ID NO: 554300 - DNA, 488 bp, Homo sapiens; identical to SEQ ID NO: 537124
  misc_feature: HIJSMM301ATJWC.11.25.C03.1.454.light.4.raw

SEQ ID NO: 554301 - DNA, 455 bp, Homo sapiens; identical to SEQ ID NO: 550155
  misc_feature: HIJSMM301AK2NW.5.86.H09.1.454.light.4.raw

SEQ ID NO: 554302 - DNA, 461 bp, Homo sapiens; identical to SEQ ID NO: 551628
  misc_feature: HIJSMM301EXUKX.15.11.A11.1.454.light.4.raw

SEQ ID NO: 554303 - DNA, 503 bp, Homo sapiens
  misc_feature: HIJSMM301EPKBV.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggcctcaggggtccctgatcgcttctctgggtccaagtctggcaacacggctccctgaccatctctgggctccaggctgaggacgaggctgattattactgcagcttatatacaggcaacaatacttttgtcttcggaactgggaccaaggtcaccgtcctaggtcagcccaaggccaacccactgtcact

SEQ ID NO: 554304 - DNA, 444 bp, Homo sapiens; identical to SEQ ID NO: 544240
  misc_feature: HIJSMM301BMI41.9.9.A09.1.454.light.4.raw
  modified_base (426)..(426): a, c, t, g, unknown or other

SEQ ID NO: 554305 - DNA, 491 bp, Homo sapiens; identical to SEQ ID NO: 535294
  misc_feature: HIJSMM301CI84U.16.68.G02.1.454.light.4.raw

SEQ ID NO: 554306 - DNA, 507 bp, Homo sapiens
  misc_feature: HIJSMM301A3V04.51.86.H09.1.454.light.4.raw
cgatcgtatacacgaccggtgctcgatttagtgctatagacttgggtttgggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggtttattactgcatgcaaggtacacactggcctgggacgttcggccaagggaccaaggtggaaatcaaacgaactgtggctgcaccatctgtcttcta

SEQ ID NO: 554307 - DNA, 453 bp, Homo sapiens
  misc_feature: HIJSMM301CESWJ.19.86.H09.1.454.light.4.raw
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 554308 - DNA, 486 bp, Homo sapiens; identical to SEQ ID NO: 535043
  misc_feature: HIJSMM301DRKTE.46.35.D02.1.454.light.4.raw

SEQ ID NO: 554309 - DNA, 445 bp, Homo sapiens
  misc_feature: HIJSMM301D2QJN.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccatgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccacctcctccatactcgta

SEQ ID NO: 554310 - DNA, 486 bp, Homo sapiens
  misc_feature: HIJSMM301BNKTV.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccctcggtcactctgttccaccctcctcga

SEQ ID NO: 554311 - DNA, 453 bp, Homo sapiens
  misc_feature: HIJSMM301AHDL6.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgcctcctccacgagagta

SEQ ID NO: 554312 - DNA, 493 bp, Homo sapiens; identical to SEQ ID NO: 535770
  misc_feature: HIJSMM301AE7IE.51.71.G05.1.454.light.4.raw

SEQ ID NO: 554313 - DNA, 522 bp, Homo sapiens; identical to SEQ ID NO: 538091
  misc_feature: HIJSMM301AK1AM.27.23.C01.1.454.light.4.raw

SEQ ID NO: 554314 - DNA, 495 bp, Homo sapiens
  misc_feature: HIJSMM301DWCM2.14.53.E09.1.454.light.4.raw
cgtctagtaccacgaccggtgctcgatttagagagagtgtgttggggtttgggggggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 554315 - DNA, 491 bp, Homo sapiens
  misc_feature: HIJSMM301CKEXH.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaggaccgaaagtaggacgatcaagcgaactgtggctgcaccatctgt

SEQ ID NO: 554316 - DNA, 507 bp, Homo sapiens
  misc_feature: HIJSMM301BKCHP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaaactgtggctgcaccactctgtcttctatcttccccg

SEQ ID NO: 554317 - DNA, 510 bp, Homo sapiens
  misc_feature: HIJSMM301ET2SJ.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaatcactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccct

SEQ ID NO: 554318 - DNA, 441 bp, Homo sapiens; identical to SEQ ID NO: 534971
  misc_feature: HIJSMM301A2NXY.11.3.A03.1.454.light.4.raw

SEQ ID NO: 554319 - DNA, 488 bp, Homo sapiens
  misc_feature: HIJSMM301B7RI8.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 554320 - DNA, 488 bp, Homo sapiens
  misc_feature: HIJSMM301AH1V5.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccgggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 554321 - DNA, 497 bp, Homo sapiens; identical to SEQ ID NO: 536376
  misc_feature: HIJSMM301DBM0A.22.9.A09.1.454.light.4.raw

SEQ ID NO: 554322 - DNA, 476 bp, Homo sapiens
  misc_feature: HIJSMM301CSM5O.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgtaaggggaaagtaatgaagttaacactgtggatcaccttcgaccaagggacacgactggagattaaacgaactgtggctgcaccatctgtcttcatcttcccgccatctgaagtatagtct

SEQ ID NO: 554323 - DNA, 481 bp, Homo sapiens; identical to SEQ ID NO: 535993
  misc_feature: HIJSMM301CLQKO.21.25.C03.1.454.light.4.raw

SEQ ID NO: 554324 - DNA, 422 bp, Homo sapiens; identical to SEQ ID NO: 447881
  misc_feature: HIJSMM301DE7O3.9.34.D01.1.454.light.4.raw

SEQ ID NO: 554325 - DNA, 501 bp, Homo sapiens
  misc_feature: HIJSMM301ASC4X.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggaggatctaaccgaacctagtggcgtgcaccactctgtt

SEQ ID NO: 554326 - DNA, 499 bp, Homo sapiens
  misc_feature: HIJSMM301C1275.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttgggggtttattactgcatgcaagctctacaacctctgcggactttcggccctgggaccaaaggtaggagatacaacgaaactgtggctgcaccatctgtcttt

SEQ ID NO: 554327 - DNA, 485 bp, Homo sapiens; identical to SEQ ID NO: 536040
  misc_feature: HIJSMM301AKI19.15.1.A01.1.454.light.4.raw

SEQ ID NO: 554328 - DNA, 486 bp, Homo sapiens; identical to SEQ ID NO: 536323
  misc_feature: HIJSMM301BNNZV.10.2.A02.1.454.light.4.raw

SEQ ID NO: 554329 - DNA, 494 bp, Homo sapiens; identical to SEQ ID NO: 534992
  misc_feature: HIJSMM301BHXJQ.9.1.A01.1.454.light.4.raw

SEQ ID NO: 554330 - DNA, 495 bp, Homo sapiens; identical to SEQ ID NO: 538269
  misc_feature: HIJSMM301ELQ41.9.1.A01.1.454.light.4.raw

SEQ ID NO: 554331 - DNA, 483 bp, Homo sapiens
  misc_feature: HIJSMM301DUHA6.41.8.A08.1.454.light.4.raw
tctatactatcacgaccggtgctcgatttagcatactctacagggcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgctaacttactattgtcaacaggctaacagttttcccgatgaccgtcggccaagggacacg

SEQ ID NO: 554332 - DNA, 494 bp, Homo sapiens; identical to SEQ ID NO: 534994
  misc_feature: HIJSMM301BN06R.27.78.H01.1.454.light.4.raw

SEQ ID NO: 554333 - DNA, 500 bp, Homo sapiens
  misc_feature: HIJSMM301BVMS5.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcacctttatgggcgtctacccgggaatccggggtccctgaccgattcagtggcagcgggtctgggacagatttcactctcaccatcagcagcctgcaggctgaagatgtggcagttttattattgtcagcaaatattatattcctcctcagacgttcggccaagggaccaaggtggaaatcaaacgaactgtggctgcacc

SEQ ID NO: 554334 - DNA, 503 bp, Homo sapiens
  misc_feature: HIJSMM301B2NA4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcggcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggaggggccaaactgaccgtcctaggtcagcccaagg

SEQ ID NO: 554335 - DNA, 489 bp, Homo sapiens
  misc_feature: HIJSMM301CG2OL.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaagggacacgactggagattaacgaactgtggctgcaccatctgtcttcat

SEQ ID NO: 554336 - DNA, 487 bp, Homo sapiens; identical to SEQ ID NO: 537079
  misc_feature: HIJSMM301A5Z03.14.55.E11.1.454.light.4.raw

SEQ ID NO: 554337 - DNA, 446 bp, Homo sapiens; identical to SEQ ID NO: 540475
  misc_feature: HIJSMM301EMWU1.18.9.A09.1.454.light.4.raw

SEQ ID NO: 554338 - DNA, 492 bp, Homo sapiens
  misc_feature: HIJSMM301ATH8J.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggtccaagggaccgaaggtggaaagtacaaacgaactagtggctgcacca

SEQ ID NO: 554339 - DNA, 512 bp, Homo sapiens; identical to SEQ ID NO: 542831
  misc_feature: HIJSMM301DKNLD.43.19.B08.1.454.light.4.raw

SEQ ID NO: 554340 - DNA, 495 bp, Homo sapiens; identical to SEQ ID NO: 549535
  misc_feature: HIJSMM301EWYWO.8.81.H04.1.454.light.4.raw

SEQ ID NO: 554341 - DNA, 494 bp, Homo sapiens
  misc_feature: HIJSMM301DGBUM.49.30.C08.1.454.light.4.raw
agtcgagagacacgaccggtgctcgatttagtctgacgtcaaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggaggatcaaacgaactgtggctgcaccatctgtctt

SEQ ID NO: 554342 - DNA, 498 bp, Homo sapiens
  misc_feature: HIJSMM301AQ5BT.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagccaaggctgccccctcggtcac

SEQ ID NO: 554343 - DNA, 463 bp, Homo sapiens; identical to SEQ ID NO: 535062
  misc_feature: HIJSMM301C13BC.11.73.G07.1.454.light.4.raw

SEQ ID NO: 554344 - DNA, 492 bp, Homo sapiens
  misc_feature: HIJSMM301C5EVU.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtttattactgtcagcagtatgatacctggcctccgtacacttttggccgggggaccaagctggaaatcaagcgaactgtggctgcaccatctgtcttcatt

SEQ ID NO: 554345 - DNA, 489 bp, Homo sapiens
  misc_feature: HIJSMM301D33GQ.3.67.G01.1.454.light.4.raw
agacgcactccacgaccggtgctcgatttagagtatacatattgggtttggggaggaactgctcagttaggacccagagggaaccatggaagccccagctcagcttctcttcctcctgctactctggctcccagatattaccggagaaattgtgttgacacagtctccagtcaccctgtctctggctccaggggaaagagccaccctctcctgtagggccagtcagagtgttgccactcacttagcctggtaccagcagaaacctggccaggctcccagactcctcatctatgatgcatccaacggggccactggcatcgcagccaggttcagtggcagtgggtctgggacagacttcactctctccatcaggaatctggagcctgaagattctgcaatttatttctgtcagcagcgtagcagctggcctcccactttcggcggagggaccaaggtggagatcaaacgaactgtggctgcaccatctgt

SEQ ID NO: 554346 - DNA, 521 bp, Homo sapiens; identical to SEQ ID NO: 539470
  misc_feature: HIJSMM301CLWCZ.27.23.C01.1.454.light.4.raw

SEQ ID NO: 554347 - DNA, 489 bp, Homo sapiens
  misc_feature: HIJSMM301AHPGU.52.17.B06.1.454.light.4.raw
cgcagtacgacacgaccggtgctcgatttagtcgatagtgaaggggtgatcaggactcctcagttcaccttctcacaatgaggctccctgctcagctcctggggctgctaatgctctgggtctctggatccagtggacaaattgtgctgactcagtctccactctccctgcccgtcacccctggagagccggcctccatctcctgcaggtctagtcagagcctcctgcattataatggataccagtatttggactggtacctacagaaggcagggcagtctccacagctcctgatctatttgggttcttatcgggcctccggggtccctgacaggttcagtggcagcggatcaggcacaaattttacactgagaatcagcagagtggaggcagaggatgttggggtttattattgcatgcaaggtctacaaactcactggacgttcggccaagggaccaaggtggaaatcaaacgaactgtggctgcac

SEQ ID NO: 554348 - DNA, 486 bp, Homo sapiens; identical to SEQ ID NO: 545031
  misc_feature: HIJSMM301BJMBK.48.10.A10.1.454.light.4.raw

SEQ ID NO: 554349 - DNA, 447 bp, Homo sapiens; identical to SEQ ID NO: 535201
  misc_feature: HIJSMM301AO43W.18.9.A09.1.454.light.4.raw

SEQ ID NO: 554350 - DNA, 517 bp, Homo sapiens
  misc_feature: HIJSMM301AGML6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaacggtggaaagtacaaacgaaacctagtggcgtgcgaccaactctgtctttctatcttccccg

SEQ ID NO: 554351 - DNA, 495 bp, Homo sapiens
  misc_feature: HIJSMM301EATO9.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcta

SEQ ID NO: 554352 - DNA, 444 bp, Homo sapiens
  misc_feature: HIJSMM301BBZED.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttcccaccctcctccgtgtctgat

SEQ ID NO: 554353 - DNA, 489 bp, Homo sapiens
  misc_feature: HIJSMM301ARM1Z.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccaagggaccaaggtggaaatcaaacgaactgtggctgcaccatctgtcttcta

SEQ ID NO: 554354 - DNA, 447 bp, Homo sapiens; identical to SEQ ID NO: 535020
  misc_feature: HIJSMM301AMJ3S.18.9.A09.1.454.light.4.raw

SEQ ID NO: 554355 - DNA, 505 bp, Homo sapiens; identical to SEQ ID NO: 540539
  misc_feature: HIJSMM301A4UMP.48.28.C06.1.454.light.4.raw

SEQ ID NO: 554356 - DNA, 463 bp, Homo sapiens; identical to SEQ ID NO: 535008
  misc_feature: HIJSMM301AIIAR.10.9.A09.1.454.light.4.raw

SEQ ID NO: 554357 - DNA, 490 bp, Homo sapiens; identical to SEQ ID NO: 538273
  misc_feature: HIJSMM301C9SSS.16.73.G07.1.454.light.4.raw

SEQ ID NO: 554358 - DNA, 484 bp, Homo sapiens; identical to SEQ ID NO: 535211
  misc_feature: HIJSMM301DRQN6.47.46.E02.1.454.light.4.raw

SEQ ID NO: 554359 - DNA, 520 bp, Homo sapiens
  misc_feature: HIJSMM301EC9FS.48.57.F02.1.454.light.4.raw
agtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccgccctcctcta

SEQ ID NO: 554360 - DNA, 404 bp, Homo sapiens; identical to SEQ ID NO: 535779
  misc_feature: HIJSMM301EA4ZC.4.35.D02.1.454.light.4.raw

SEQ ID NO: 554361 - DNA, 492 bp, Homo sapiens
  misc_feature: HIJSMM301C0FUZ.14.5.A05.1.454.light.4.raw
cgtctagtaccacgaccggtgctcgatttagatagatagacagggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcgcggagggaccgaaggtggagatcaaacgaactgtggctgcaccatctgtcttcta

SEQ ID NO: 554362 - DNA, 474 bp, Homo sapiens
  misc_feature: HIJSMM301B5PQH.52.19.B08.1.454.light.4.raw
cgcagtacgacacgaccggtgctcgatttagtgagtcagtaaggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagatttttactttcaccatcagcaggctgcagcctgaagatgttgcaacatattactgtcaacagtataatcgtctcccgctcactttcgcgggggaccgaaggtggagatcaagcgaactgtgctgcacca

SEQ ID NO: 554363 - DNA, 492 bp, Homo sapiens
  misc_feature: HIJSMM301DQEBF.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcaggtcagcccaagg

SEQ ID NO: 554364 - DNA, 476 bp, Homo sapiens
  misc_feature: HIJSMM301E0Z02.18.76.G10.1.454.light.4.raw
  modified_base (147)..(147): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatnccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggactagattttaatttcaccatcagcagcctccaacgtgatgatgttgcaacatactattgtcagcaatatgatttgctctccgagtgccacgttttggcggggggaccaaggtggacaatcaaacgtaacg

SEQ ID NO: 554365 - DNA, 484 bp, Homo sapiens
  misc_feature: HIJSMM301BD81W.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcattttgatgcctccactttgaatggaggggtcccaccaacattcagcggcagtggatctgggacagagttcactctcacaatcagcagcctgcagcctgatgatcttggaacttattactgccaacaatataatagttattggacgtttcggccagggacgaaggtcgaaatgagacgaactgtggctgcaccatctgtt

SEQ ID NO: 554366 - DNA, 478 bp, Homo sapiens; identical to SEQ ID NO: 535129
  misc_feature: HIJSMM301B3Y8D.11.11.A11.1.454.light.4.raw

SEQ ID NO: 554367 - DNA, 494 bp, Homo sapiens; identical to SEQ ID NO: 536974
  misc_feature: HIJSMM301CAZLV.16.86.H09.1.454.light.4.raw

SEQ ID NO: 554368 - DNA, 497 bp, Homo sapiens; identical to SEQ ID NO: 540516
  misc_feature: HIJSMM301A19LR.52.55.E11.1.454.light.4.raw

SEQ ID NO: 554369 - DNA, 518 bp, Homo sapiens
  misc_feature: HIJSMM301AKWA1.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaaagctgaccgtcctaggtcagcccaaggctgccccctccggtcactctgttcccgccctcctctcgta

SEQ ID NO: 554370 - DNA, 493 bp, Homo sapiens
  misc_feature: HIJSMM301AGUXE.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatacagcagagtggaggctgaggatgttggggtttattactgcatgcaagctctacaaactccttacacttttggccaggggaccgaagctggagatcaaacgaactgt

SEQ ID NO: 554371 - DNA, 494 bp, Homo sapiens
  misc_feature: HIJSMM301CA7LP.13.9.A09.1.454.light.4.raw
tcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcgtcggagggaccagtctgaccgtcttaggtcagcccaaggctgccccctcggtcactctgttccca

SEQ ID NO: 554372 - DNA, 513 bp, Homo sapiens
  misc_feature: HIJSMM301DLDJ0.51.35.D02.1.454.light.4.raw
cgatcgtatacacgaccggtgctcgatttagcacacgatagttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcaatcgcttctctggctccaagtccggcaacacggcctccctgaccatctctggcctccaggccgaggacgaggctgattattactgcagctcatatacaatcaataacaattgggtgttcgggcggagggaccaaactgaccgtcctaggtcagcccaaggctgccccctggtccactctcg

SEQ ID NO: 554373 - DNA, 490 bp, Homo sapiens; identical to SEQ ID NO: 536404
  misc_feature: HIJSMM301EF7F4.47.55.E11.1.454.light.4.raw

SEQ ID NO: 554374 - DNA, 492 bp, Homo sapiens
  misc_feature: HIJSMM301AY390.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaaactgtggctgcaccatct

SEQ ID NO: 554375 - DNA, 486 bp, Homo sapiens; identical to SEQ ID NO: 535043
  misc_feature: HIJSMM301B0W2L.46.35.D02.1.454.light.4.raw

SEQ ID NO: 554376 - DNA, 489 bp, Homo sapiens; identical to SEQ ID NO: 535139
  misc_feature: HIJSMM301BWAIF.14.55.E11.1.454.light.4.raw

SEQ ID NO: 554377 - DNA, 485 bp, Homo sapiens
  misc_feature: HIJSMM301BZNWX.49.61.F06.1.454.light.4.raw
agtcgagagacacgaccggtgctcgatttagctacgctctaagggaaaggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacc

SEQ ID NO: 554378 - DNA, 481 bp, Homo sapiens; identical to SEQ ID NO: 535993
  misc_feature: HIJSMM301BWGUV.21.25.C03.1.454.light.4.raw

SEQ ID NO: 554379 - DNA, 487 bp, Homo sapiens; identical to SEQ ID NO: 537220
  misc_feature: HIJSMM301AYPU4.16.53.E09.1.454.light.4.raw

SEQ ID NO: 554380 - DNA, 505 bp, Homo sapiens; identical to SEQ ID NO: 535987
  misc_feature: HIJSMM301CTSBP.18.37.D04.1.454.light.4.raw

SEQ ID NO: 554381 - DNA, 495 bp, Homo sapiens; identical to SEQ ID NO: 535821
  misc_feature: HIJSMM301CKLNG.3.31.C09.1.454.light.4.raw

SEQ ID NO: 554382 - DNA, 513 bp, Homo sapiens; identical to SEQ ID NO: 535244
  misc_feature: HIJSMM301D8IPL.17.33.C11.1.454.light.4.raw

SEQ ID NO: 554383 - DNA, 447 bp, Homo sapiens; identical to SEQ ID NO: 535020
  misc_feature: HIJSMM301AD7C8.18.9.A09.1.454.light.4.raw

SEQ ID NO: 554384 - DNA, 489 bp, Homo sapiens
  misc_feature: HIJSMM301BQ2QQ.40.33.C11.1.454.light.4.raw
tctagcgactcacgaccggtgctcgatttagagtgagctcgttgggtttgggtcaccgcagcctgagaatccactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctcggtcactctgttcccgccctcctcagtcgctaga

SEQ ID NO: 554385 - DNA, 463 bp, Homo sapiens; identical to SEQ ID NO: 535062
  misc_feature: HIJSMM301AFNBZ.11.73.G07.1.454.light.4.raw

SEQ ID NO: 554386 - DNA, 510 bp, Homo sapiens
  misc_feature: HIJSMM301D718X.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaacgctgaccgtcctgggtcgagcccaaggctgccccctccggtcacctctgttcccgccctccctctacgtcgtat

SEQ ID NO: 554387 - DNA, 522 bp, Homo sapiens; identical to SEQ ID NO: 543470
  misc_feature: HIJSMM301AH4TD.5.27.C05.1.454.light.4.raw

SEQ ID NO: 554388 - DNA, 444 bp, Homo sapiens; identical to SEQ ID NO: 535027
  misc_feature: HIJSMM301B04BD.8.73.G07.1.454.light.4.raw

SEQ ID NO: 554389 - DNA, 484 bp, Homo sapiens; identical to SEQ ID NO: 536162
  misc_feature: HIJSMM301ECM2F.13.59.F04.1.454.light.4.raw

SEQ ID NO: 554390 - DNA, 511 bp, Homo sapiens
  misc_feature: HIJSMM301EUXZX.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagttttcagtgtcccccggacgttcggtccagggaccgacacgtagaaatagagacgaacgtagtggcgtgcaccaactctgtcttctatcttcccgt

SEQ ID NO: 554391 - DNA, 454 bp, Homo sapiens; identical to SEQ ID NO: 536347
  misc_feature: HIJSMM301D5SPE.19.86.H09.1.454.light.4.raw

SEQ ID NO: 554392 - DNA, 481 bp, Homo sapiens
  misc_feature: HIJSMM301DV0HJ.49.15.B04.1.454.light.4.raw
agtcgagagacacgaccggtgctcgatttagacagtatatatccgcgggcacgaccggtgctcgatttagatcgtctgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattc

SEQ ID NO: 554393 - DNA, 509 bp, Homo sapiens
  misc_feature: HIJSMM301B7T9R.48.34.D01.1.454.light.4.raw
agtatacatacacgaccggtgctcgatttagatcgtctgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccgaaggtggaggtcgaaacgaactgtggctgcaccatctgtctt

SEQ ID NO: 554394 - DNA, 460 bp, Homo sapiens
  misc_feature: HIJSMM301BZ4SR.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctattcccgccctcctcacgcgtatgt

SEQ ID NO: 554395 - DNA, 499 bp, Homo sapiens; identical to SEQ ID NO: 537739
  misc_feature: HIJSMM301CWM68.12.86.H09.1.454.light.4.raw

SEQ ID NO: 554396 - DNA, 503 bp, Homo sapiens; identical to SEQ ID NO: 538884
  misc_feature: HIJSMM301B8EFS.27.78.H01.1.454.light.4.raw

SEQ ID NO: 554397 - DNA, 462 bp, Homo sapiens
  misc_feature: HIJSMM301A6VAL.51.1.A01.1.454.light.4.raw
cgatcgtatacacgaccggtgctcgatttagacgtctcatcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaaacgaa

SEQ ID NO: 554398 - DNA, 487 bp, Homo sapiens
  misc_feature: HIJSMM301D7QQA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 554399 - DNA, 490 bp, Homo sapiens; identical to SEQ ID NO: 543909
  misc_feature: HIJSMM301DD3SU.14.55.E11.1.454.light.4.raw

SEQ ID NO: 554400 - DNA, 503 bp, Homo sapiens; identical to SEQ ID NO: 543109
  misc_feature: HIJSMM301EBVYY.19.78.H01.1.454.light.4.raw

SEQ ID NO: 554401 - DNA, 521 bp, Homo sapiens; identical to SEQ ID NO: 539470
  misc_feature: HIJSMM301AS56V.27.23.C01.1.454.light.4.raw

SEQ ID NO: 554402 - DNA, 505 bp, Homo sapiens; identical to SEQ ID NO: 536254
  misc_feature: HIJSMM301BXXH9.7.71.G05.1.454.light.4.raw

SEQ ID NO: 554403 - DNA, 516 bp, Homo sapiens
  misc_feature: HIJSMM301C9MCD.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcacatctgtcttcatcttcccg

SEQ ID NO: 554404 - DNA, 498 bp, Homo sapiens; identical to SEQ ID NO: 535295
  misc_feature: HIJSMM301BHIOJ.15.25.C03.1.454.light.4.raw

SEQ ID NO: 554405 - DNA, 520 bp, Homo sapiens
  misc_feature: HIJSMM301DJF3D.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtgt

SEQ ID NO: 554406 - DNA, 497 bp, Homo sapiens
  misc_feature: HIJSMM301EU9WE.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccc

SEQ ID NO: 554407 - DNA, 480 bp, Homo sapiens
  misc_feature: HIJSMM301C4JW5.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccacctcccaaactcctatcctacaggaataacaaccggccctcagggatctcggagagattctctgcatccaggtcaggatacacagcctccctgaccattacctggactccagcctgaggacgaggctgactattactgctcagcatgggacagcagcctccgtggtgtggtgatcggcggagggaccaggctgaccgtcctaggt

SEQ ID NO: 554408 - DNA, 479 bp, Homo sapiens
  misc_feature: HIJSMM301APBBF.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtgggtcccaccaacgttcagtggcagtggatctgggacagagttcactctcaccatcagcagcctgcagcctgatgatcttggaacttattactgccaacaatataataattattggacgttcggccaggggaccaaggtcgaaatagagacgaactgtggctgcaccatctgtt

SEQ ID NO: 554409 - DNA, 444 bp, Homo sapiens; identical to SEQ ID NO: 534993
  misc_feature: HIJSMM301ADNPD.5.9.A09.1.454.light.4.raw

SEQ ID NO: 554410 - DNA, 496 bp, Homo sapiens; identical to SEQ ID NO: 535109
  misc_feature: HIJSMM301AMU25.16.78.H01.1.454.light.4.raw

SEQ ID NO: 554411 - DNA, 494 bp, Homo sapiens; identical to SEQ ID NO: 535828
  misc_feature: HIJSMM301DZDG8.3.36.D03.1.454.light.4.raw

SEQ ID NO: 554412 - DNA, 479 bp, Homo sapiens; identical to SEQ ID NO: 535118
  misc_feature: HIJSMM301B606N.13.59.F04.1.454.light.4.raw

SEQ ID NO: 554413 - DNA, 482 bp, Homo sapiens
  misc_feature: HIJSMM301AI9O2.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaacgaa

SEQ ID NO: 554414 - DNA, 500 bp, Homo sapiens
  misc_feature: HIJSMM301BE2OK.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgcc

SEQ ID NO: 554415 - DNA, 503 bp, Homo sapiens; identical to SEQ ID NO: 536850
  misc_feature: HIJSMM301BVZSY.4.57.F02.1.454.light.4.raw

SEQ ID NO: 554416 - DNA, 520 bp, Homo sapiens
  misc_feature: HIJSMM301AHR49.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtcactctgttcccaccct

SEQ ID NO: 554417 - DNA, 478 bp, Homo sapiens; identical to SEQ ID NO: 544974
  misc_feature: HIJSMM301D1WMH.5.28.C06.1.454.light.4.raw

SEQ ID NO: 554418 - DNA, 494 bp, Homo sapiens
  misc_feature: HIJSMM301A5E2H.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggtccaagggaccgaaggtaggaaatacaaacgaaactagtggctgcaccatctgtatt

SEQ ID NO: 554419 - DNA, 487 bp, Homo sapiens
  misc_feature: HIJSMM301CQ7ZT.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggtccgagggacgaagctgagatcagcgaacg

SEQ ID NO: 554420 - DNA, 494 bp, Homo sapiens; identical to SEQ ID NO: 534994
  misc_feature: HIJSMM301DWFVK.27.78.H01.1.454.light.4.raw

SEQ ID NO: 554421 - DNA, 494 bp, Homo sapiens; identical to SEQ ID NO: 539894
  misc_feature: HIJSMM301BU964.16.53.E09.1.454.light.4.raw

SEQ ID NO: 554422 - DNA, 480 bp, Homo sapiens
  misc_feature: HIJSMM301CWOT8.3.50.E06.1.454.light.4.raw
agacgcactccacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagcaaaaaccagggaaagccctaaacttttgatctatgctgcatccagtttgcaaagtggggtcccatcaaggttcaatggcagtggatctgggacagatttcactctcaccatcagcagtctacagcctgaagattttgcaacttactactgtcaacagagttacagtacttggtatttcactttcggccctgggaccaagtggacatcaacgaactgtgg

SEQ ID NO: 554423 - DNA, 502 bp, Homo sapiens
  misc_feature: HIJSMM301E11CY.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactcgtcactctgtt

SEQ ID NO: 554424 - DNA, 514 bp, Homo sapiens
  misc_feature: HIJSMM301BF5IO.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 554425 - DNA, 493 bp, Homo sapiens
  misc_feature: HIJSMM301A6LJQ.19.75.G09.1.454.light.4.raw
tactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaaggggcagcttggctgcagcagcaccggggccaccctcccaagctcctgtcctacaggaataccaaccggccctcagggatctcagagagattctctgcatccaggtcaggaaacacagcctccctgaccatttctggactccagcctgacgacgaggctgactattactgttcagcgtgggacagcagcctcgctgcttgggtgttcggcggagggaccaagctgaccctctgggtcagcccaaggccacccac

SEQ ID NO: 554426 - DNA, 483 bp, Homo sapiens; identical to SEQ ID NO: 542674
  misc_feature: HIJSMM301AD1GJ.21.25.C03.1.454.light.4.raw

SEQ ID NO: 554427 - DNA, 513 bp, Homo sapiens
  misc_feature: HIJSMM301CEVTE.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcct

SEQ ID NO: 554428 - DNA, 521 bp, Homo sapiens; identical to SEQ ID NO: 539470
  misc_feature: HIJSMM301E11N3.27.23.C01.1.454.light.4.raw

SEQ ID NO: 554429 - DNA, 481 bp, Homo sapiens
  misc_feature: HIJSMM301EL146.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttatactgcatgcaagctctacaaactcctctcactttcggcggaggaccaaggtgagatcaacgaact

SEQ ID NO: 554430 - DNA, 515 bp, Homo sapiens
  misc_feature: HIJSMM301DAGIL.40.46.E02.1.454.light.4.raw
tctagcgactcacgaccggtgctcgatttagactcatctacagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtggggagacaacattgggagtaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccacctcctcagtcgctaga

SEQ ID NO: 554431 - DNA, 490 bp, Homo sapiens
  misc_feature: HIJSMM301ATY79.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagttttatttctgtctgcagtacaatcagtggcctcggacgttcggccaagggaccaaggtggaaatcaaacgaactgtggctgcaccatctgtcttcta

SEQ ID NO: 554432 - DNA, 485 bp, Homo sapiens; identical to SEQ ID NO: 536576
  misc_feature: HIJSMM301BYUXL.46.35.D02.1.454.light.4.raw

SEQ ID NO: 554433 - DNA, 494 bp, Homo sapiens
  misc_feature: HIJSMM301A517S.3.10.A10.1.454.light.4.raw
  modified_base (445)..(445): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccacggacagacggccaagatcacctgctctggagatgcattgccaaagcaatatgcttattggtaccaacaaaagaccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacaagtaatacttatctttatgtcttcgganctgggaccagggtcaccgtcctaggtcgacgcccaacggccaaccccca

SEQ ID NO: 554434 - DNA, 507 bp, Homo sapiens
  misc_feature: HIJSMM301BA3AM.8.28.C06.1.454.light.4.raw
ctcgcgtgtccacgaccggtgctcgatttagagctcacgtattgggtttgggggaggaactgctcagttaggacccagacggaaccatggaagccccagcgaagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 554435 - DNA, 495 bp, Homo sapiens
  misc_feature: HIJSMM301BACPK.51.28.C06.1.454.light.4.raw
cgatcgtatacacgaccggtgctcgatttagagctcacgtattgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 554436 - DNA, 505 bp, Homo sapiens
  misc_feature: HIJSMM301CRZM3.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcgggcggagggaccaagctgaccgtcctaagtcagcccaaggctgccccctcggtcta

SEQ ID NO: 554437 - DNA, 493 bp, Homo sapiens
  misc_feature: HIJSMM301CUXXR.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggcccatcactgggctccagactgaggatgaggctcattattactgccagtcttatgacaaacgtcagaacatttgggtgttcggcggagggaccaagctgaccgtcctcagtcagcccc

SEQ ID NO: 554438 - DNA, 502 bp, Homo sapiens
  misc_feature: HIJSMM301AVMG9.17.10.A10.1.454.light.4.raw
  modified_base (455)..(455): a, c, t, g, unknown or other
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctcggaaaccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtatttctgcgcaacatgggattccagcctgacttctggggtnttcggcagtgggaccaagctgaccgtcctaggtcagcccaaggctcg

SEQ ID NO: 554439 - DNA, 489 bp, Homo sapiens
  misc_feature: HIJSMM301BGBAI.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgcaccatctgtcttcta

SEQ ID NO: 554440 - DNA, 443 bp, Homo sapiens
  misc_feature: HIJSMM301DO4H3.9.9.A09.1.454.light.4.raw
tgatacgtctcacgaccggtgctcgatttagcgagacgcgcagggtcctgggcccagtctgtgctgacgcagtcgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 554441 - DNA, 475 bp, Homo sapiens; identical to SEQ ID NO: 544617
  misc_feature: HIJSMM301ELMS1.13.76.G10.1.454.light.4.raw

SEQ ID NO: 554442 - DNA, 484 bp, Homo sapiens; identical to SEQ ID NO: 535240
  misc_feature: HIJSMM301EG7LD.47.60.F05.1.454.light.4.raw

SEQ ID NO: 554443 - DNA, 502 bp, Homo sapiens
  misc_feature: HIJSMM301BK99Z.43.71.G05.1.454.light.4.raw
tgtgagtagtcacgaccggtgctcgatttagtgtcgtcgcaagagagaggggcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgact

SEQ ID NO: 554444 - DNA, 495 bp, Homo sapiens; identical to SEQ ID NO: 535143
  misc_feature: HIJSMM301BGL9H.51.29.C07.1.454.light.4.raw

SEQ ID NO: 554445 - DNA, 502 bp, Homo sapiens
  misc_feature: HIJSMM301EZT4T.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctcgaccgattcaatggcagcgggtctggggcagatttcactctcaccatcagcagcctgcaggctgaagatgtggcagtttattactgtcagcaatattatactcctcttccgacgttcggccaagggaccaaggtggaaatcaaacgaactagtggctgcaccat

SEQ ID NO: 554446 - DNA, 499 bp, Homo sapiens; identical to SEQ ID NO: 536030
  misc_feature: HIJSMM301ARA5C.48.23.C01.1.454.light.4.raw

SEQ ID NO: 554447 - DNA, 456 bp, Homo sapiens
  misc_feature: HIJSMM301D62LU.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctcacgagagta

SEQ ID NO: 554448 - DNA, 447 bp, Homo sapiens; identical to SEQ ID NO: 535020
  misc_feature: HIJSMM301ALOWE.18.9.A09.1.454.light.4.raw

SEQ ID NO: 554449 - DNA, 503 bp, Homo sapiens
  misc_feature: HIJSMM301D1BIV.52.34.D01.1.454.light.4.raw
  modified_base (225)..(225): a, c, t, g, unknown or other
cgcagtacgacacgaccggtgctcgatttagatcgtctgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggaaaaccngtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 554450 - DNA, 499 bp, Homo sapiens; identical to SEQ ID NO: 537739
  misc_feature: HIJSMM301ELD2X.12.86.H09.1.454.light.4.raw

SEQ ID NO: 554451 - DNA, 481 bp, Homo sapiens
  misc_feature: HIJSMM301ATYKT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcgagggaccaaggtgagatcaacgaa

SEQ ID NO: 554452 - DNA, 480 bp, Homo sapiens
  misc_feature: HIJSMM301BN2MO.41.17.B06.1.454.light.4.raw
tctatactatcacgaccggtgctcgatttagtcgatagtgaaggggggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcaccat

SEQ ID NO: 554453 - DNA, 487 bp, Homo sapiens
  misc_feature: HIJSMM301CYDSF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaaacgaactgtggctgcaccat

SEQ ID NO: 554454 - DNA, 478 bp, Homo sapiens; identical to SEQ ID NO: 540986
  misc_feature: HIJSMM301C96PO.16.86.H09.1.454.light.4.raw

SEQ ID NO: 554455 - DNA, 485 bp, Homo sapiens; identical to SEQ ID NO: 536576
  misc_feature: HIJSMM301EUA2O.46.35.D02.1.454.light.4.raw

SEQ ID NO: 554456 - DNA, 494 bp, Homo sapiens; identical to SEQ ID NO: 534994
  misc_feature: HIJSMM301EVS1I.27.78.H01.1.454.light.4.raw

SEQ ID NO: 554457 - DNA, 499 bp, Homo sapiens
  misc_feature: HIJSMM301BM4KV.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactagctcatttactgggcatctacccgggaatccggggcccctgaccgattcaatggcagcgggtctgggcagatttcactctcaccatcagcagcctgcaggctgaagatgtggcagttattactgtcagcaatattatactcctcttccgacgttcgccaagggaccaaggtggaaatcaaacgaactagtggctgcaccat

SEQ ID NO: 554458 - DNA, 496 bp, Homo sapiens; identical to SEQ ID NO: 535109
  misc_feature: HIJSMM301EZ0GG.16.78.H01.1.454.light.4.raw

SEQ ID NO: 554459 - DNA, 486 bp, Homo sapiens; identical to SEQ ID NO: 535043
  misc_feature: HIJSMM301A261R.46.35.D02.1.454.light.4.raw

SEQ ID NO: 554460 - DNA, 473 bp, Homo sapiens; identical to SEQ ID NO: 546369
  misc_feature: HIJSMM301A5K74.18.76.G10.1.454.light.4.raw

SEQ ID NO: 554461 - DNA, 505 bp, Homo sapiens; identical to SEQ ID NO: 550196
  misc_feature: HIJSMM301BYCRH.10.27.C05.1.454.light.4.raw

SEQ ID NO: 554462 - DNA, 495 bp, Homo sapiens
  misc_feature: HIJSMM301AJ2PM.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaaccca

SEQ ID NO: 554463 - DNA, 486 bp, Homo sapiens; identical to SEQ ID NO: 535290
  misc_feature: HIJSMM301DN1DV.3.12.B01.1.454.light.4.raw

SEQ ID NO: 554464 - DNA, 496 bp, Homo sapiens
  misc_feature: HIJSMM301C1JRT.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtgtaca

SEQ ID NO: 554465 - DNA, 480 bp, Homo sapiens
  misc_feature: HIJSMM301A61KX.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagccaaggctgccccctc

SEQ ID NO: 554466 - DNA, 480 bp, Homo sapiens
  misc_feature: HIJSMM301B0Z5T.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcccttgggaccaatgtggatatcaaacgaactgtggctgcaccatct

SEQ ID NO: 554467 - DNA, 494 bp, Homo sapiens
  misc_feature: HIJSMM301B2H1L.9.19.B08.1.454.light.4.raw
  modified_base (451)..(451): a, c, t, g, unknown or other
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtnttcggcggagggaccaagctggaccgtcctcagtcaagccccg

SEQ ID NO: 554468 - DNA, 484 bp, Homo sapiens; identical to SEQ ID NO: 537878
  misc_feature: HIJSMM301EWLRW.17.34.D01.1.454.light.4.raw

SEQ ID NO: 554469 - DNA, 485 bp, Homo sapiens
  misc_feature: HIJSMM301ES1VV.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaaggacacgactggagattaaacgaactgtggctgcaccatctgt

SEQ ID NO: 554470 - DNA, 488 bp, Homo sapiens; identical to SEQ ID NO: 535861
  misc_feature: HIJSMM301DMUPQ.14.55.E11.1.454.light.4.raw

SEQ ID NO: 554471 - DNA, 517 bp, Homo sapiens
  misc_feature: HIJSMM301A5DJ9.40.14.B03.1.454.light.4.raw
tctagcgactcacgaccggtgctcgatttagtgtgagtagttccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgtaggcggcaacaattgggtcttcggcggagggaccaagctgaccgtcctaggtcagcccaaggctgccccctcggtcactctgttcccgccct

SEQ ID NO: 554472 - DNA, 504 bp, Homo sapiens
  misc_feature: HIJSMM301C4O6F.8.28.C06.1.454.light.4.raw
ctcgcgtgtccacgaccggtgctcgatttagagctcacgtattgggtttgggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 554473 - DNA, 505 bp, Homo sapiens
  misc_feature: HIJSMM301AKM1F.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccccgtccgaggttcagtggcagtggatctgggacacatttcaccctcaccatcaatagcctggaagctgaagatgctgcaacttattactgtcatcagagtactactttacctacagtagatcacctccgtccgaggacgacgactggagataaacg

SEQ ID NO: 554474 - DNA, 485 bp, Homo sapiens; identical to SEQ ID NO: 536723
  misc_feature: HIJSMM301C647N.5.40.D07.1.454.light.4.raw

SEQ ID NO: 554475 - DNA, 490 bp, Homo sapiens; identical to SEQ ID NO: 535234
  misc_feature: HIJSMM301CD8C2.17.21.B10.1.454.light.4.raw

SEQ ID NO: 554476 - DNA, 490 bp, Homo sapiens
  misc_feature: HIJSMM301BEMWS.49.26.C04.1.454.light.4.raw
agtcgagagacacgaccggtgctcgatttagtctagcgactttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtctt

SEQ ID NO: 554477 - DNA, 494 bp, Homo sapiens; identical to SEQ ID NO: 534992
  misc_feature: HIJSMM301EIXC7.9.1.A01.1.454.light.4.raw

SEQ ID NO: 554478 - DNA, 503 bp, Homo sapiens
  misc_feature: HIJSMM301BHLJE.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttggtgttcggcggagggaccaaactggaccgtcctaggtcaggcccaa

SEQ ID NO: 554479 - DNA, 489 bp, Homo sapiens
  misc_feature: HIJSMM301DVMCX.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtctaggtcagaccccg

SEQ ID NO: 554480 - DNA, 493 bp, Homo sapiens
  misc_feature: HIJSMM301DIV3J.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcgcgggggaccaagctggagatcaaccgaactgtggctgcaccatctgtt

SEQ ID NO: 554481 - DNA, 495 bp, Homo sapiens; identical to SEQ ID NO: 535007
  misc_feature: HIJSMM301CRSZM.22.5.A05.1.454.light.4.raw

SEQ ID NO: 554482 - DNA, 484 bp, Homo sapiens; identical to SEQ ID NO: 535240
  misc_feature: HIJSMM301D9HPU.47.60.F05.1.454.light.4.raw

SEQ ID NO: 554483 - DNA, 509 bp, Homo sapiens; identical to SEQ ID NO: 543772
  misc_feature: HIJSMM301DPH0Y.2.21.B10.1.454.light.4.raw

SEQ ID NO: 554484 - DNA, 487 bp, Homo sapiens
  misc_feature: HIJSMM301AOIM8.49.53.E09.1.454.light.4.raw
agtcgagagacacgaccggtgctcgatttagagagagtgtgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaaggctgaccgtcctaggtcagcccaaggctcg

SEQ ID NO: 554485 - DNA, 482 bp, Homo sapiens; identical to SEQ ID NO: 544159
  misc_feature: HIJSMM301DST5Q.4.74.G08.1.454.light.4.raw

SEQ ID NO: 554486 - DNA, 495 bp, Homo sapiens
  misc_feature: HIJSMM301EFEWY.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactcggcctctctactttcggcggacgggaccgagggtggagatcagacgaactgtggctgcaccatctgtt

SEQ ID NO: 554487 - DNA, 475 bp, Homo sapiens
  misc_feature: HIJSMM301BDMXB.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagccccg

SEQ ID NO: 554488 - DNA, 497 bp, Homo sapiens; identical to SEQ ID NO: 535664
  misc_feature: HIJSMM301A0B57.22.14.B03.1.454.light.4.raw

SEQ ID NO: 554489 - DNA, 448 bp, Homo sapiens
  misc_feature: HIJSMM301D4WEH.18.9.A09.1.454.light.4.raw
  modified_base (413)..(413): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaaggtcagcccaaggccaaccccnctgtcactctgttcccaccctcctccatactcgta

SEQ ID NO: 554490 - DNA, 423 bp, Homo sapiens
  misc_feature: HIJSMM301B1DA9.41.14.B03.1.454.light.4.raw
tctatactatcacgaccggtgctcgatttagtgtgagtagttccgcgggcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtggatctgggacagacttcactctctccatcagcagactggagcctgaagattttgcaatttattactgtcaccagtatggtagttcacctctaaactttcggcggagggaccaaggtggagatcaaacgaactgtggctgcaccatctgtcttcatcttcccgccatctgaatagtataga

SEQ ID NO: 554491 - DNA, 501 bp, Homo sapiens
  misc_feature: HIJSMM301C2566.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactgtggctgcaccatctgtcttcatt

SEQ ID NO: 554492 - DNA, 494 bp, Homo sapiens
  misc_feature: HIJSMM301C3HAK.51.35.D02.1.454.light.4.raw
cgatcgtatacacgaccggtgctcgatttagcacacgatagttgggtttgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagaccccg

SEQ ID NO: 554493 - DNA, 502 bp, Homo sapiens; identical to SEQ ID NO: 536253
  misc_feature: HIJSMM301A2OOL.21.22.B11.1.454.light.4.raw

SEQ ID NO: 554494 - DNA, 504 bp, Homo sapiens
  misc_feature: HIJSMM301B61DM.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatacaaacgaactgtggctgcaccatctgtcttcatcttcccgcc

SEQ ID NO: 554495 - DNA, 494 bp, Homo sapiens; identical to SEQ ID NO: 534994
  misc_feature: HIJSMM301ELKOH.27.78.H01.1.454.light.4.raw

SEQ ID NO: 554496 - DNA, 495 bp, Homo sapiens; identical to SEQ ID NO: 535596
  misc_feature: HIJSMM301AL9DN.10.79.H02.1.454.light.4.raw

SEQ ID NO: 554497 - DNA, 508 bp, Homo sapiens
  misc_feature: HIJSMM301B5OD0.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaacggtaggaaagtacaaacgaactagtggcgtgcaccactctgtt

SEQ ID NO: 554498 - DNA, 502 bp, Homo sapiens
  misc_feature: HIJSMM301B35HS.5.24.C02.1.454.light.4.raw
  modified_base (378)..(378): a, c, t, g, unknown or other
atcagacacgcacgaccggtgctcgatttagtacagatcgttaggggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcaagtatgtctcctggtaccaacaacaccccgacaaagcccccaaactcatcatttttgaggtcactacgcgaccctcaggggtccctgatcgcttctctggctccaagtctggcaacacggcctcctgaccgtcnctgggctccaggctgaggatgaggctgattattactgcagctcatatgcaggcagcagcagtccccatgtgatcttcggcgggggaccaagctgaccgtcctaggtcagcccaaggctgccccc

SEQ ID NO: 554499 - DNA, 475 bp, Homo sapiens
  misc_feature: HIJSMM301BG9RU.43.87.H10.1.454.light.4.raw
tgtgagtagtcacgaccggtgctcgatttagcagtactgcgttgggtttggggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtct

SEQ ID NO: 554500 - DNA, 482 bp, Homo sapiens; identical to SEQ ID NO: 535352
  misc_feature: HIJSMM301ADBIP.16.81.H04.1.454.light.4.raw

SEQ ID NO: 554501 - DNA, 383 bp, Homo sapiens; identical to SEQ ID NO: 447524
  misc_feature: HIJSMM301B9R4K.41.26.C04.1.454.light.4.raw

SEQ ID NO: 554502 - DNA, 492 bp, Homo sapiens; identical to SEQ ID NO: 536175
  misc_feature: HIJSMM301EVKI8.19.83.H06.1.454.light.4.raw

SEQ ID NO: 554503 - DNA, 485 bp, Homo sapiens; identical to SEQ ID NO: 535880
  misc_feature: HIJSMM301AO2KL.7.75.G09.1.454.light.4.raw

SEQ ID NO: 554504 - DNA, 415 bp, Homo sapiens
  misc_feature: HIJSMM301BUCYG.4.61.F06.1.454.light.4.raw
agcactgtagcacgaccggtgctcgatttagctacgctctaagggaaagggggaagacaatgggtttgatttagatcacagaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtatttttgtcagcagtatggcacatcaccggtcaccttcggccaagggtcacggctggagattaaacgaactgtggctgcaccatctgtcttcatcttcccgccatctgactacagtgct

SEQ ID NO: 554505 - DNA, 520 bp, Homo sapiens
  misc_feature: HIJSMM301EOE83.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgccggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcct

SEQ ID NO: 554506 - DNA, 493 bp, Homo sapiens; identical to SEQ ID NO: 544316
  misc_feature: HIJSMM301AFJ55.9.1.A01.1.454.light.4.raw

SEQ ID NO: 554507 - DNA, 504 bp, Homo sapiens; identical to SEQ ID NO: 549053
  misc_feature: HIJSMM301EGVKR.4.71.G05.1.454.light.4.raw

SEQ ID NO: 554508 - DNA, 508 bp, Homo sapiens; identical to SEQ ID NO: 537871
  misc_feature: HIJSMM301ANRU2.8.33.C11.1.454.light.4.raw

SEQ ID NO: 554509 - DNA, 471 bp, Homo sapiens
  misc_feature: HIJSMM301ANGZ0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctcctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgatgccacttttggcggggggaccaaggtggacatcaacgaa

SEQ ID NO: 554510 - DNA, 504 bp, Homo sapiens; identical to SEQ ID NO: 535077
  misc_feature: HIJSMM301AD8RU.8.28.C06.1.454.light.4.raw

SEQ ID NO: 554511 - DNA, 496 bp, Homo sapiens
  misc_feature: HIJSMM301BMQHJ.21.65.F10.1.454.light.4.raw
tcgtcgctcgcacgaccggtgctcgatttagctacgctctaagggggagggaactgctcagttaggacccacgacggaaccatggaagccccacgcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactggggtctgggacagagttcactctcaccatcagcagcctgcagtctgaagattttgaagtttatttctgtctgcagtacaatcagtgggccctcgggacgttcggccgaagggaccaaggtaggaatcaaacgaactgtggctgcacatctgtcttcta

SEQ ID NO: 554512 - DNA, 488 bp, Homo sapiens
  misc_feature: HIJSMM301BYMYN.16.73.G07.1.454.light.4.raw
tgtactactccacgaccggtgctcgatttagctctacgctcaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttccgcc

SEQ ID NO: 554513 - DNA, 519 bp, Homo sapiens
  misc_feature: HIJSMM301ANCMO.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccacggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttattcggggtggtttcgggcggggggaccggaaacgcgtgaccggtcccttagggtcaagcccaacggctgcccccgtcccggtcgacctctgtt

SEQ ID NO: 554514 - DNA, 441 bp, Homo sapiens; identical to SEQ ID NO: 534971
  misc_feature: HIJSMM301B3V8B.11.3.A03.1.454.light.4.raw

SEQ ID NO: 554515 - DNA, 502 bp, Homo sapiens
  misc_feature: HIJSMM301CMXU8.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 554516 - DNA, 505 bp, Homo sapiens
  misc_feature: HIJSMM301AVILJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtccaaggaccgaacggtaggaagtacaaacgaactagtggcgtgcaccatctgtcttcatcttccccg

SEQ ID NO: 554517 - DNA, 493 bp, Homo sapiens; identical to SEQ ID NO: 535084
  misc_feature: HIJSMM301AMPY1.47.64.F09.1.454.light.4.raw

SEQ ID NO: 554518 - DNA, 445 bp, Homo sapiens
  misc_feature: HIJSMM301CD7E4.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatagttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 554519 - DNA, 496 bp, Homo sapiens
  misc_feature: HIJSMM301BD5OP.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcacc

SEQ ID NO: 554520 - DNA, 519 bp, Homo sapiens
  misc_feature: HIJSMM301D5V7C.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctc

SEQ ID NO: 554521 - DNA, 497 bp, Homo sapiens; identical to SEQ ID NO: 535664
  misc_feature: HIJSMM301B45IK.22.14.B03.1.454.light.4.raw

SEQ ID NO: 554522 - DNA, 491 bp, Homo sapiens
  misc_feature: HIJSMM301C4OKE.49.46.E02.1.454.light.4.raw
agtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtt

SEQ ID NO: 554523 - DNA, 480 bp, Homo sapiens
  misc_feature: HIJSMM301AI1WQ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaccaaggaaaagcccctaaactcctgatctctgctgccgccagtttgcaaagtggggtcccatcaagattcagtggcagtggatctgggacagatttcactctcgccatcagtagtctgcaacctgatgtattttgcaacttactactgtcaacagagttccactaccccaatcactttcggcccgtggacgtagaagtgcatatagaagagaactgtggctgca

SEQ ID NO: 554524 - DNA, 495 bp, Homo sapiens; identical to SEQ ID NO: 536359
  misc_feature: HIJSMM301BPMAE.48.4.A04.1.454.light.4.raw

SEQ ID NO: 554525 - DNA, 503 bp, Homo sapiens; identical to SEQ ID NO: 536834
  misc_feature: HIJSMM301A8T0X.2.35.D02.1.454.light.4.raw

SEQ ID NO: 554526 - DNA, 498 bp, Homo sapiens
  misc_feature: HIJSMM301EGJF2.3.33.C11.1.454.light.4.raw
agacgcactccacgaccggtgctcgatttagagtgagctcgttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcgaggacgaagactgacgtcctaggtcagccaacggctcgtccccccg

SEQ ID NO: 554527 - DNA, 496 bp, Homo sapiens; identical to SEQ ID NO: 535541
  misc_feature: HIJSMM301BLCMP.3.33.C11.1.454.light.4.raw

SEQ ID NO: 554528 - DNA, 494 bp, Homo sapiens; identical to SEQ ID NO: 535276
  misc_feature: HIJSMM301DUYSP.16.6.A06.1.454.light.4.raw

SEQ ID NO: 554529 - DNA, 415 bp, Homo sapiens; identical to SEQ ID NO: 535434
  misc_feature: HIJSMM301CPQ3Q.16.46.E02.1.454.light.4.raw

SEQ ID NO: 554530 - DNA, 495 bp, Homo sapiens
  misc_feature: HIJSMM301C01YL.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccgagggtgggaggatcagacgaactgtggctgcaccatctgtt

SEQ ID NO: 554531 - DNA, 502 bp, Homo sapiens
  misc_feature: HIJSMM301CVS0T.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtcta

SEQ ID NO: 554532 - DNA, 501 bp, Homo sapiens
  misc_feature: HIJSMM301A4KFU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctctacgttcggacggacggaaccgaaggcggagatacgaacgaacgtaacgtggtcggtctcgaccacctattc

SEQ ID NO: 554533 - DNA, 464 bp, Homo sapiens
  misc_feature: HIJSMM301ATA7T.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggaggatcaagcgaa

SEQ ID NO: 554534 - DNA, 474 bp, Homo sapiens
  misc_feature: HIJSMM301BXBJC.51.47.E03.1.454.light.4.raw
cgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagccc

SEQ ID NO: 554535 - DNA, 493 bp, Homo sapiens
  misc_feature: HIJSMM301A7FDC.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgaccggtggagtgtctaagcgaacgtacgtggcgtgcaccact

SEQ ID NO: 554536 - DNA, 490 bp, Homo sapiens; identical to SEQ ID NO: 535420
  misc_feature: HIJSMM301ESNL7.3.72.G06.1.454.light.4.raw

SEQ ID NO: 554537 - DNA, 463 bp, Homo sapiens
  misc_feature: HIJSMM301CZO2J.52.24.C02.1.454.light.4.raw
  modified_base (316)..(316): a, c, t, g, unknown or other
cgcagtacgacacgaccggtgctcgatttagtacagatcgttagggaaaggggaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagtagagggcacagcaactacgccatcgcatggcatcagcagcagccagagaagggccctgatacttgatgatgttttanagtgatgggagtcacatcaagggggacggatccctgctcgcttctcaggctccagctctgggactgggcgccacctcatcatctccagcctccagtctgaggatgaggctgattattactgtcagacctggggcactggcattcggg

SEQ ID NO: 554538 - DNA, 460 bp, Homo sapiens; identical to SEQ ID NO: 536053
  misc_feature: HIJSMM301DHHPN.22.28.C06.1.454.light.4.raw

SEQ ID NO: 554539 - DNA, 491 bp, Homo sapiens
  misc_feature: HIJSMM301COUGH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcatctcccg

SEQ ID NO: 554540 - DNA, 488 bp, Homo sapiens
  misc_feature: HIJSMM301CWMJ5.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgtagtttattactgtcagcagtatcatgactggccgctcaccttcggccaagggacacgactggagattaaacgaactgtggctgcaccatctgt

SEQ ID NO: 554541 - DNA, 505 bp, Homo sapiens
  misc_feature: HIJSMM301AOV5W.48.26.C04.1.454.light.4.raw
agtatacatacacgaccggtgctcgatttagtctagcgactttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 554542 - DNA, 489 bp, Homo sapiens
  misc_feature: HIJSMM301ADWSK.3.33.C11.1.454.light.4.raw
agacgcactccacgaccggtgctcgatttagagtgagctcgttggggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcga

SEQ ID NO: 554543 - DNA, 485 bp, Homo sapiens; identical to SEQ ID NO: 536630
  misc_feature: HIJSMM301A49Y0.13.56.F01.1.454.light.4.raw

SEQ ID NO: 554544 - DNA, 500 bp, Homo sapiens
  misc_feature: HIJSMM301DGRE4.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccgccctcctcgctcgtaga

SEQ ID NO: 554545 - DNA, 505 bp, Homo sapiens
  misc_feature: HIJSMM301AECW3.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggggaccaaacctgaccgtcctaggtcagcccaac

SEQ ID NO: 554546 - DNA, 521 bp, Homo sapiens; identical to SEQ ID NO: 538715
  misc_feature: HIJSMM301BELY2.27.23.C01.1.454.light.4.raw

SEQ ID NO: 554547 - DNA, 473 bp, Homo sapiens
  misc_feature: HIJSMM301AYADN.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaactgtgg

SEQ ID NO: 554548 - DNA, 508 bp, Homo sapiens
  misc_feature: HIJSMM301CHVE0.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggtcggaggcaccaaggtgaccgtcctaggtcagcccaaggctgccccctcggtcta

SEQ ID NO: 554549 - DNA, 515 bp, Homo sapiens
  misc_feature: HIJSMM301C8SIO.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttcccg

SEQ ID NO: 554550 - DNA, 517 bp, Homo sapiens
  misc_feature: HIJSMM301ASVMG.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggtccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctcg

SEQ ID NO: 554551 - DNA, 495 bp, Homo sapiens; identical to SEQ ID NO: 535143
  misc_feature: HIJSMM301DYVGU.51.29.C07.1.454.light.4.raw

SEQ ID NO: 554552 - DNA, 495 bp, Homo sapiens
  misc_feature: HIJSMM301EGKIV.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactcggtaccccagccaggttcagtggcagtgggtctgggacagagttcactctcaccatcagcagcctgcagtctgaagatttgcagtttattactgtcagcagtataattactggcctcggacgttcggccgaagggaccgaaggtggaagtacaaacgaactagtggctgcaccatctgtctt

SEQ ID NO: 554553 - DNA, 502 bp, Homo sapiens
  misc_feature: HIJSMM301B8SMA.48.79.H02.1.454.light.4.raw
agtatacatacacgaccggtgctcgatttagtgtcacacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcggcctccgggtccctgacaggttcagtggcagtggatcaggcacagattttacactgaaaatcagcagagtggaggctgaggatgttggggtttattactgcatgcaagctctacaaactcctcgggcgttcggccaagggaccgaaggtaggaagtacaaacgaaactagtaggcgtgtcacca

SEQ ID NO: 554554 - DNA, 497 bp, Homo sapiens; identical to SEQ ID NO: 535664
  misc_feature: HIJSMM301C3V6X.22.14.B03.1.454.light.4.raw

SEQ ID NO: 554555 - DNA, 486 bp, Homo sapiens
  misc_feature: HIJSMM301DT0F2.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcaccca

SEQ ID NO: 554556 - DNA, 447 bp, Homo sapiens; identical to SEQ ID NO: 535201
  misc_feature: HIJSMM301AJVSL.18.9.A09.1.454.light.4.raw

SEQ ID NO: 554557 - DNA, 504 bp, Homo sapiens; identical to SEQ ID NO: 537401
  misc_feature: HIJSMM301E0DRH.51.23.C01.1.454.light.4.raw

SEQ ID NO: 554558 - DNA, 489 bp, Homo sapiens; identical to SEQ ID NO: 535139
  misc_feature: HIJSMM301CKNYT.14.55.E11.1.454.light.4.raw

SEQ ID NO: 554559 - DNA, 483 bp, Homo sapiens
  misc_feature: HIJSMM301DUZW5.48.30.C08.1.454.light.4.raw
agtatacatacacgaccggtgctcgatttagtctgacgtcaaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctcgttcacttcggcgcggaccaggtggagatcaacgaactgtggctgcaccat

SEQ ID NO: 554560 - DNA, 479 bp, Homo sapiens; identical to SEQ ID NO: 535188
  misc_feature: HIJSMM301DH4D5.10.74.G08.1.454.light.4.raw

SEQ ID NO: 554561 - DNA, 445 bp, Homo sapiens; identical to SEQ ID NO: 537719
  misc_feature: HIJSMM301D0G6O.47.85.H08.1.454.light.4.raw

SEQ ID NO: 554562 - DNA, 481 bp, Homo sapiens
  misc_feature: HIJSMM301EAUOD.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggtcggagggaccaaggtggaggatcaaacgaactgtggctgca

SEQ ID NO: 554563 - DNA, 498 bp, Homo sapiens
  misc_feature: HIJSMM301AENA5.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatactccccacctttcggccctcgggaccaaacgtaggagtattcaaaccgaaactacgtggtctgcaccatctgtt

SEQ ID NO: 554564 - DNA, 497 bp, Homo sapiens
  misc_feature: HIJSMM301D1SKJ.22.15.B04.1.454.light.4.raw
acatacgcgtcacgaccggtgctcgatttagacagtatatatccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaaggtggaaaatcaaacgaactgtggctgca

SEQ ID NO: 554565 - DNA, 499 bp, Homo sapiens
  misc_feature: HIJSMM301EAQK5.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggct

SEQ ID NO: 554566 - DNA, 444 bp, Homo sapiens; identical to SEQ ID NO: 537971
  misc_feature: HIJSMM301EMZZ2.2.76.G10.1.454.light.4.raw

SEQ ID NO: 554567 - DNA, 478 bp, Homo sapiens
  misc_feature: HIJSMM301BFARK.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaaggaccgaaggtggag

SEQ ID NO: 554568 - DNA, 508 bp, Homo sapiens; identical to SEQ ID NO: 547873
  misc_feature: HIJSMM301DGN69.47.83.H06.1.454.light.4.raw

SEQ ID NO: 554569 - DNA, 478 bp, Homo sapiens; identical to SEQ ID NO: 535129
  misc_feature: HIJSMM301BAX8V.11.11.A11.1.454.light.4.raw

SEQ ID NO: 554570 - DNA, 494 bp, Homo sapiens; identical to SEQ ID NO: 541183
  misc_feature: HIJSMM301C5JVZ.19.71.G05.1.454.light.4.raw

SEQ ID NO: 554571 - DNA, 503 bp, Homo sapiens
  misc_feature: HIJSMM301BW090.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccacctcctctacgtcgtat

SEQ ID NO: 554572 - DNA, 492 bp, Homo sapiens; identical to SEQ ID NO: 537666
  misc_feature: HIJSMM301D686A.43.33.C11.1.454.light.4.raw

SEQ ID NO: 554573 - DNA, 494 bp, Homo sapiens; identical to SEQ ID NO: 540664
  misc_feature: HIJSMM301CXNL4.47.64.F09.1.454.light.4.raw

SEQ ID NO: 554574 - DNA, 447 bp, Homo sapiens
  misc_feature: HIJSMM301BCZUR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggacgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 554575 - DNA, 507 bp, Homo sapiens
  misc_feature: HIJSMM301EGTRK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatacaaacgaaactgtggctgcaccatctgtcttcatcttccccg

SEQ ID NO: 554576 - DNA, 494 bp, Homo sapiens; identical to SEQ ID NO: 534994
  misc_feature: HIJSMM301D2I1Z.27.78.H01.1.454.light.4.raw

SEQ ID NO: 554577 - DNA, 447 bp, Homo sapiens; identical to SEQ ID NO: 535201
  misc_feature: HIJSMM301BLZDK.18.9.A09.1.454.light.4.raw

SEQ ID NO: 554578 - DNA, 527 bp, Homo sapiens
  misc_feature: HIJSMM301AFV6V.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaacggtggcgaatcaaccgaacctagtggcgtgcaccactctgtctttcattcttcccccg

SEQ ID NO: 554579 - DNA, 511 bp, Homo sapiens; identical to SEQ ID NO: 549837
  misc_feature: HIJSMM301AQMYE.15.34.D01.1.454.light.4.raw

SEQ ID NO: 554580 - DNA, 498 bp, Homo sapiens
  misc_feature: HIJSMM301EUNW7.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcctgggaccaagtgatatcaaacgaactgtggctgcaccatct

SEQ ID NO: 554581 - DNA, 491 bp, Homo sapiens
  misc_feature: HIJSMM301D3NY2.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggactgacccgtcctcggtcagcccaaggctgccccatcggtcactctgttccccaccctcctctagtacggtgactgaggcggtcgtggacgaagggccgactaagtag

SEQ ID NO: 554582 - DNA, 513 bp, Homo sapiens
  misc_feature: HIJSMM301DF54U.8.88.H11.1.454.light.4.raw
ctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgcc

SEQ ID NO: 554583 - DNA, 504 bp, Homo sapiens; identical to SEQ ID NO: 535077
  misc_feature: HIJSMM301DI5UD.8.28.C06.1.454.light.4.raw

SEQ ID NO: 554584 - DNA, 517 bp, Homo sapiens; identical to SEQ ID NO: 536262
  misc_feature: HIJSMM301D9YNC.14.70.G04.1.454.light.4.raw

SEQ ID NO: 554585 - DNA, 490 bp, Homo sapiens
  misc_feature: HIJSMM301DH7PB.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggccaaggtggaggtcaaacgaactgtggctgcaccatctgtcttcatt

SEQ ID NO: 554586 - DNA, 500 bp, Homo sapiens
  misc_feature: HIJSMM301D7MYJ.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagccctgcagtctgaggaccttggagtttattactgtcagcagtatcataactggcctccgtggacgttcggccaagggaccaacggtggacctcaaaccgaactgtggctgcaccat

SEQ ID NO: 554587 - DNA, 490 bp, Homo sapiens
  misc_feature: HIJSMM301BU6OL.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtggacatcaagcgaactgtgctgcaccatctgt

SEQ ID NO: 554588 - DNA, 516 bp, Homo sapiens
  misc_feature: HIJSMM301EQ95V.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggtggagggaccaagctgaccgtcctaggtcagcccaaggctgccccctcggtcactctgttcccaccctcctctcgta

SEQ ID NO: 554589 - DNA, 512 bp, Homo sapiens
  misc_feature: HIJSMM301EWGD3.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 554590 - DNA, 494 bp, Homo sapiens
  misc_feature: HIJSMM301C594F.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggaccaagctggagatcaaacgaactgtggctgcaccatctgtctt

SEQ ID NO: 554591 - DNA, 498 bp, Homo sapiens; identical to SEQ ID NO: 553891
  misc_feature: HIJSMM301DR3O1.3.33.C11.1.454.light.4.raw

SEQ ID NO: 554592 - DNA, 505 bp, Homo sapiens; identical to SEQ ID NO: 536233
  misc_feature: HIJSMM301BXQ8D.48.25.C03.1.454.light.4.raw

SEQ ID NO: 554593 - DNA, 489 bp, Homo sapiens; identical to SEQ ID NO: 535139
  misc_feature: HIJSMM301BO8VV.14.55.E11.1.454.light.4.raw

SEQ ID NO: 554594 - DNA, 509 bp, Homo sapiens
  misc_feature: HIJSMM301DHAWC.17.33.C11.1.454.light.4.raw
cgtagactagcacgaccggtgctcgatttagagtgagctcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagcagcccaaggctgccccctc

SEQ ID NO: 554595 - DNA, 354 bp, Homo sapiens; identical to SEQ ID NO: 535026
  misc_feature: HIJSMM301A9X3F.19.22.B11.1.454.light.4.raw

SEQ ID NO: 554596 - DNA, 493 bp, Homo sapiens
  misc_feature: HIJSMM301D0CNT.43.29.C07.1.454.light.4.raw
tgtgagtagtcacgaccggtgctcgatttagagtgctacgaagggaaaggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggaggatcaaacgaactgtggctgcaccatctgtcttcta

SEQ ID NO: 554597 - DNA, 494 bp, Homo sapiens; identical to SEQ ID NO: 534994
  misc_feature: HIJSMM301CP3SB.27.78.H01.1.454.light.4.raw

SEQ ID NO: 554598 - DNA, 493 bp, Homo sapiens
  misc_feature: HIJSMM301DBROI.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattatactgcagctcatatagaagtggcagcactctcgtattcggcggtgggaccaagctgaccgtcctaggtcagcccaagg

SEQ ID NO: 554599 - DNA, 501 bp, Homo sapiens; identical to SEQ ID NO: 536142
  misc_feature: HIJSMM301EQSLB.15.1.A01.1.454.light.4.raw

SEQ ID NO: 554600 - DNA, 494 bp, Homo sapiens; identical to SEQ ID NO: 541183
  misc_feature: HIJSMM301CIC52.19.71.G05.1.454.light.4.raw

SEQ ID NO: 554601 - DNA, 513 bp, Homo sapiens; identical to SEQ ID NO: 535244
  misc_feature: HIJSMM301AP0HA.17.33.C11.1.454.light.4.raw

SEQ ID NO: 554602 - DNA, 490 bp, Homo sapiens; identical to SEQ ID NO: 535936
  misc_feature: HIJSMM301BAYYK.16.68.G02.1.454.light.4.raw

SEQ ID NO: 554603 - DNA, 528 bp, Homo sapiens
  misc_feature: HIJSMM301AP4FC.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgtagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaagtacgaaacgaaactacgtggcgtgcaccactctgtcttctactcttcccgtcccactcctgat

SEQ ID NO: 554604 - DNA, 491 bp, Homo sapiens; identical to SEQ ID NO: 535294
  misc_feature: HIJSMM301A33R6.16.68.G02.1.454.light.4.raw

SEQ ID NO: 554605 - DNA, 494 bp, Homo sapiens
  misc_feature: HIJSMM301A0BEB.5.57.F02.1.454.light.4.raw
atcagacacgcacgaccggtgctcgatttagctcgatatagttgggtttggggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 554606 - DNA, 486 bp, Homo sapiens; identical to SEQ ID NO: 537617
  misc_feature: HIJSMM301B5VBS.10.53.E09.1.454.light.4.raw

SEQ ID NO: 554607 - DNA, 522 bp, Homo sapiens; identical to SEQ ID NO: 548113
  misc_feature: HIJSMM301D8QI9.27.23.C01.1.454.light.4.raw

SEQ ID NO: 554608 - DNA, 494 bp, Homo sapiens; identical to SEQ ID NO: 535680
  misc_feature: HIJSMM301EUNFM.16.78.H01.1.454.light.4.raw

SEQ ID NO: 554609 - DNA, 404 bp, Homo sapiens; identical to SEQ ID NO: 535530
  misc_feature: HIJSMM301CVOX0.4.35.D02.1.454.light.4.raw

SEQ ID NO: 554610 - DNA, 488 bp, Homo sapiens; identical to SEQ ID NO: 535081
  misc_feature: HIJSMM301B49AO.26.23.C01.1.454.light.4.raw

SEQ ID NO: 554611 - DNA, 493 bp, Homo sapiens; identical to SEQ ID NO: 535047
  misc_feature: HIJSMM301DDPZ8.16.53.E09.1.454.light.4.raw

SEQ ID NO: 554612 - DNA, 454 bp, Homo sapiens; identical to SEQ ID NO: 534964
  misc_feature: HIJSMM301EKGGK.19.86.H09.1.454.light.4.raw

SEQ ID NO: 554613 - DNA, 487 bp, Homo sapiens
  misc_feature: HIJSMM301DUGCE.49.34.D01.1.454.light.4.raw
agtcgagagacacgaccggtgctcgatttagatcgtctgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccgagggtggaggatcaaaacg

SEQ ID NO: 554614 - DNA, 503 bp, Homo sapiens; identical to SEQ ID NO: 540136
  misc_feature: HIJSMM301C70XI.19.10.A10.1.454.light.4.raw

SEQ ID NO: 554615 - DNA, 490 bp, Homo sapiens; identical to SEQ ID NO: 535234
  misc_feature: HIJSMM301BPI1B.17.21.B10.1.454.light.4.raw

SEQ ID NO: 554616 - DNA, 498 bp, Homo sapiens
  misc_feature: HIJSMM301CR2MW.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgctagtttactattgtcagcagtatagtaacgggccgctcactttcggcggagggaccaaggtggagatcaaacgaactgtggctgcaccatctgtcttcta

SEQ ID NO: 554617 - DNA, 441 bp, Homo sapiens; identical to SEQ ID NO: 535074
  misc_feature: HIJSMM301EBSHQ.11.3.A03.1.454.light.4.raw

SEQ ID NO: 554618 - DNA, 493 bp, Homo sapiens; identical to SEQ ID NO: 535745
  misc_feature: HIJSMM301BR4BE.47.78.H01.1.454.light.4.raw

SEQ ID NO: 554619 - DNA, 494 bp, Homo sapiens; identical to SEQ ID NO: 534992
  misc_feature: HIJSMM301C1VWT.9.1.A01.1.454.light.4.raw

SEQ ID NO: 554620 - DNA, 480 bp, Homo sapiens
  misc_feature: HIJSMM301DZNCB.4.29.C07.1.454.light.4.raw
agcactgtagcacgaccggtgctcgatttagagtgctacgaagggaaagggggctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccagggtggaaatcaaacgaactgtggctgcaccat

SEQ ID NO: 554621 - DNA, 497 bp, Homo sapiens; identical to SEQ ID NO: 539058
  misc_feature: HIJSMM301AOKXN.12.87.H10.1.454.light.4.raw

SEQ ID NO: 554622 - DNA, 496 bp, Homo sapiens; identical to SEQ ID NO: 537513
  misc_feature: HIJSMM301CGEOZ.12.87.H10.1.454.light.4.raw

SEQ ID NO: 554623 - DNA, 501 bp, Homo sapiens
  misc_feature: HIJSMM301C9IUQ.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtca

SEQ ID NO: 554624 - DNA, 491 bp, Homo sapiens; identical to SEQ ID NO: 538021
  misc_feature: HIJSMM301C9E1M.3.72.G06.1.454.light.4.raw

SEQ ID NO: 554625 - DNA, 489 bp, Homo sapiens
  misc_feature: HIJSMM301AZZS2.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccgaggggaccaagctggagatacaaacgaactgtggctgcaccat

SEQ ID NO: 554626 - DNA, 460 bp, Homo sapiens; identical to SEQ ID NO: 536053
  misc_feature: HIJSMM301CL85F.22.28.C06.1.454.light.4.raw

SEQ ID NO: 554627 - DNA, 456 bp, Homo sapiens
  misc_feature: HIJSMM301EF2GK.49.84.H07.1.454.light.4.raw
agtcgagagacacgaccggtgctcgatttagcagacgtctgtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 554628 - DNA, 444 bp, Homo sapiens; identical to SEQ ID NO: 535192
  misc_feature: HIJSMM301DENUU.5.9.A09.1.454.light.4.raw

SEQ ID NO: 554629 - DNA, 520 bp, Homo sapiens
  misc_feature: HIJSMM301B72LQ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcacttctccgtccctaccctcctacg

SEQ ID NO: 554630 - DNA, 494 bp, Homo sapiens
  misc_feature: HIJSMM301B4SUA.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtccctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctcgaccgtcttaggtcagcccaaggctcgccccctcggtcactcc

SEQ ID NO: 554631 - DNA, 504 bp, Homo sapiens; identical to SEQ ID NO: 536728
  misc_feature: HIJSMM301BFY6U.19.78.H01.1.454.light.4.raw

SEQ ID NO: 554632 - DNA, 492 bp, Homo sapiens; identical to SEQ ID NO: 535126
  misc_feature: HIJSMM301CBZWZ.18.11.A11.1.454.light.4.raw

SEQ ID NO: 554633 - DNA, 481 bp, Homo sapiens
  misc_feature: HIJSMM301BE5MP.41.60.F05.1.454.light.4.raw
  modified_base (372)..(372): a, c, t, g, unknown or other
tctatactatcacgaccggtgctcgatttagtacgtcatcagggaaagggggatcaggactcctcagttcaccttctcacaatgaggctccctgctcagctcctggggctgctaatgctctgggtctctggatccagtggggatattgtgatgactcagtctccactctccctgtccgtcagccctggagagccggcctccatctcctgcaggtctagtcagagcctcctgtattctaatggatacagtaatttgaattggtacgtgcggaagccagggcagtctccacagctcctgatatattgggcttctcatcgggcctccggggtccctgacaggttcagtggcagtgggtcaggcacagattttacnctgcacatcagcagagtggaggctgaggatgctgcgacttattactgcatgcaacctctacaaactgtgtggacgttcggccaggggaccagggtggaaatcaagcgaa

SEQ ID NO: 554634 - DNA, 505 bp, Homo sapiens; identical to SEQ ID NO: 536117
  misc_feature: HIJSMM301CGJGA.8.71.G05.1.454.light.4.raw

SEQ ID NO: 554635 - DNA, 491 bp, Homo sapiens
  misc_feature: HIJSMM301A4UVL.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtt

SEQ ID NO: 554636 - DNA, 444 bp, Homo sapiens; identical to SEQ ID NO: 535594
  misc_feature: HIJSMM301ADB2Z.9.9.A09.1.454.light.4.raw

SEQ ID NO: 554637 - DNA, 513 bp, Homo sapiens
  misc_feature: HIJSMM301AEM1D.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggatcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaacgggaccgaacggtagggaaagtactaaacgaaacctagtggcgtcggtcacccactactcgttc

SEQ ID NO: 554638 - DNA, 501 bp, Homo sapiens
  misc_feature: HIJSMM301EE0VZ.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagccccaaggcccaaccccactgtcactctccg

SEQ ID NO: 554639 - DNA, 479 bp, Homo sapiens; identical to SEQ ID NO: 540873
  misc_feature: HIJSMM301B4C9B.40.59.F04.1.454.light.4.raw

SEQ ID NO: 554640 - DNA, 487 bp, Homo sapiens; identical to SEQ ID NO: 536536
  misc_feature: HIJSMM301ENBY2.26.45.E01.1.454.light.4.raw

SEQ ID NO: 554641 - DNA, 487 bp, Homo sapiens
  misc_feature: HIJSMM301A2Z2R.4.51.E07.1.454.light.4.raw
agcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccaggtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagattttggagtttattactgtcagcagtataataactggcctctcactttcggcggagggaccaaggtggagatcaaacgaactgtggctgcacc

SEQ ID NO: 554642 - DNA, 488 bp, Homo sapiens
  misc_feature: HIJSMM301DVDJA.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaaggaccaaggtggaaatcaaacgaactgtggctgcaccat

SEQ ID NO: 554643 - DNA, 519 bp, Homo sapiens
  misc_feature: HIJSMM301ET69P.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagacgaacgtacgtaggtcgtggcaccaactcttgttctttcctatcttcccgt

SEQ ID NO: 554644 - DNA, 505 bp, Homo sapiens
  misc_feature: HIJSMM301A7OIZ.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncggggcgttcggccaagggaccaaggtggaaatcaaacgaaactgtggctgcaccatctgtcttctatcttccccg

SEQ ID NO: 554645 - DNA, 482 bp, Homo sapiens
  misc_feature: HIJSMM301CEK9H.49.38.D05.1.454.light.4.raw
agtcgagagacacgaccggtgctcgatttagtatctgatagttgggtttgggggaatcagtcccactcaggacacagcatggacatgagggtccccgctcagctcctggggctcctgctgctctggttcccaggtgccaggtgtggcatccaggtgacccagtctccatcctccctgtctgcatctgtaggagacagagtcaccatcacctgccgggcaagtcaggacattagaaacgatttaggctggtatcagcagaaagcagggcaagcccctaagcgcctgatctatggtgcagccagtttgcacggtggggtcccatcaagattcagcggcagtggatctgggacagaattcactctcacaatcagcagcctgcagcctgaagattttgcaacttattactgtctacagcataatagtaacccttggacgttcggccaagggaccagggtggaaatcaaacgaactgtggctgcacc

SEQ ID NO: 554646 - DNA, 502 bp, Homo sapiens
  misc_feature: HIJSMM301A0SY1.14.3.A03.1.454.light.4.raw
cgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtctaggtcagccaaggctgccccctcggtcactctcg

SEQ ID NO: 554647 - DNA, 495 bp, Homo sapiens
  misc_feature: HIJSMM301D17YE.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagatttgcagtttatactgtcagcactataatagttggccgctcactttcggcggagggtaccaaggtggagctcaacgaactgtggctgcaccatctgtcttcatt

SEQ ID NO: 554648 - DNA, 487 bp, Homo sapiens; identical to SEQ ID NO: 537079
  misc_feature: HIJSMM301EZBGB.14.55.E11.1.454.light.4.raw

SEQ ID NO: 554649 - DNA, 490 bp, Homo sapiens; identical to SEQ ID NO: 546304
  misc_feature: HIJSMM301BEK7I.8.12.B01.1.454.light.4.raw

SEQ ID NO: 554650 - DNA, 506 bp, Homo sapiens
  misc_feature: HIJSMM301AH38T.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtctaagtcagcccaaggctgccccctcggtcactctgttcccgccctcc

SEQ ID NO: 554651 - DNA, 497 bp, Homo sapiens
  misc_feature: HIJSMM301B36DM.14.53.E09.1.454.light.4.raw
cgtctagtaccacgaccggtgctcgatttagagagagtgtgttggggtttgggggggtccgaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggt

SEQ ID NO: 554652 - DNA, 486 bp, Homo sapiens
  misc_feature: HIJSMM301CJ6EV.47.85.H08.1.454.light.4.raw
agctcacgtacacgaccggtgctcgatttagtatcactcagtcgcggggtcctgggcccagtctgcccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgccctcctctacgtgacgtctcgtagcgggcggtcggtcggacggacggccgactaagtag

SEQ ID NO: 554653 - DNA, 505 bp, Homo sapiens
  misc_feature: HIJSMM301AYKZG.51.26.C04.1.454.light.4.raw
cgatcgtatacacgaccggtgctcgatttagtctagcgactttgggtttggggtgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggaggggaccagtctgaccgtcctaggtcagcccaaggctgccccctcggtcactctgttccccg

SEQ ID NO: 554654 - DNA, 489 bp, Homo sapiens
  misc_feature: HIJSMM301EV8WE.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcag

SEQ ID NO: 554655 - DNA, 377 bp, Homo sapiens; identical to SEQ ID NO: 536071
  misc_feature: HIJSMM301AQNN3.40.9.A09.1.454.light.4.raw

SEQ ID NO: 554656 - DNA, 508 bp, Homo sapiens; identical to SEQ ID NO: 535835
  misc_feature: HIJSMM301ATAMI.8.34.D01.1.454.light.4.raw

SEQ ID NO: 554657 - DNA, 444 bp, Homo sapiens; identical to SEQ ID NO: 537971
  misc_feature: HIJSMM301BPNFK.2.76.G10.1.454.light.4.raw

SEQ ID NO: 554658 - DNA, 487 bp, Homo sapiens; identical to SEQ ID NO: 536206
  misc_feature: HIJSMM301AWSSK.47.38.D05.1.454.light.4.raw

SEQ ID NO: 554659 - DNA, 491 bp, Homo sapiens
  misc_feature: HIJSMM301BMNC3.26.78.H01.1.454.light.4.raw
agactatactcacgaccggtgctcgatttagtgtgagtagtttgggtttgggggaggaactgctcagttaggacccagagggaaccatggaaggccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgattgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccagggtggagatcagacgaactgtggctgcaccatct

SEQ ID NO: 554660 - DNA, 513 bp, Homo sapiens; identical to SEQ ID NO: 539678
  misc_feature: HIJSMM301BRTH8.17.37.D04.1.454.light.4.raw

SEQ ID NO: 554661 - DNA, 506 bp, Homo sapiens
  misc_feature: HIJSMM301BXFSV.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 554662 - DNA, 487 bp, Homo sapiens; identical to SEQ ID NO: 535583
  misc_feature: HIJSMM301BDGVI.22.73.G07.1.454.light.4.raw

SEQ ID NO: 554663 - DNA, 495 bp, Homo sapiens
  misc_feature: HIJSMM301CJI3B.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaacgcccctaagctcctgatctacgctgcgtctagtttacagagtggagtcccatcaaggttcagcggcagtggatcgtggcacagtatttcactctcaccatcagcagcctgcagcctgaggtattttgctaacttattactgtctacaagtattacaccttaccctgggtacgttcggccgaacggaaccgaaggtaggaaatacaaacgaactagtggctgcaccta

SEQ ID NO: 554664 - DNA, 506 bp, Homo sapiens
  misc_feature: HIJSMM301A4L1V.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccacgggaccgaccagtagaaatagagacgaaactgtggctgcaccatctgtcttctatcttcccgt

SEQ ID NO: 554665 - DNA, 507 bp, Homo sapiens
  misc_feature: HIJSMM301AEPRQ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtggatatcaaacgaactagtggctgcaccatctgtt

SEQ ID NO: 554666 - DNA, 492 bp, Homo sapiens; identical to SEQ ID NO: 540428
  misc_feature: HIJSMM301ALCR8.51.81.H04.1.454.light.4.raw

SEQ ID NO: 554667 - DNA, 508 bp, Homo sapiens
  misc_feature: HIJSMM301CW5UJ.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 554668 - DNA, 488 bp, Homo sapiens; identical to SEQ ID NO: 535861
  misc_feature: HIJSMM301D4Z5I.14.55.E11.1.454.light.4.raw

SEQ ID NO: 554669 - DNA, 506 bp, Homo sapiens; identical to SEQ ID NO: 551204
  misc_feature: HIJSMM301DZ4OI.15.59.F04.1.454.light.4.raw

SEQ ID NO: 554670 - DNA, 493 bp, Homo sapiens
  misc_feature: HIJSMM301ANQ17.10.72.G06.1.454.light.4.raw
catagtagtgcacgaccggtgctcgatttagctacgactgcaagggaaaggggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 554671 - DNA, 496 bp, Homo sapiens
  misc_feature: HIJSMM301AD3DC.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccgaaggtaggaggatcaaacgaaactagtggctgcaccatctgtt

SEQ ID NO: 554672 - DNA, 497 bp, Homo sapiens; identical to SEQ ID NO: 538296
  misc_feature: HIJSMM301DYZUC.18.11.A11.1.454.light.4.raw

SEQ ID NO: 554673 - DNA, 495 bp, Homo sapiens
  misc_feature: HIJSMM301CP7JI.41.49.E05.1.454.light.4.raw
tctatactatcacgaccggtgctcgatttagagcgactagcaacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaatttattactgtcagcagcgtatcaactggcctccgtggacgttcggccaaggaccaaggtggaaatcaaacgaactgtggctgcaccatctgtt

SEQ ID NO: 554674 - DNA, 487 bp, Homo sapiens
  misc_feature: HIJSMM301BZ61W.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgctagtttattactgtcagcagtataatagctggcccgcgacgttcggccaagggaccgaggtggaattcaaacgaactgtggctgcaccatctgtctt

SEQ ID NO: 554675 - DNA, 487 bp, Homo sapiens
  misc_feature: HIJSMM301CLMGZ.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccaaggtggatctcaaagaactgtggctgcacc

SEQ ID NO: 554676 - DNA, 493 bp, Homo sapiens; identical to SEQ ID NO: 548342
  misc_feature: HIJSMM301C1IAH.27.78.H01.1.454.light.4.raw

SEQ ID NO: 554677 - DNA, 487 bp, Homo sapiens
  misc_feature: HIJSMM301A9HE1.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgcaactttactactgtcaacagagtttcagtatcccttgggactttcggccgaagggaccgaaggtaggaaagtacaaacgaacgtgtgg

SEQ ID NO: 554678 - DNA, 495 bp, Homo sapiens; identical to SEQ ID NO: 553683
  misc_feature: HIJSMM301AGZO3.48.1.A01.1.454.light.4.raw

SEQ ID NO: 554679 - DNA, 465 bp, Homo sapiens
  misc_feature: HIJSMM301CV40X.12.7.A07.1.454.light.4.raw
  modified_base (453)..(453): a, c, t, g, unknown or other
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacatacctcgaacgtgtcacgacgaacgaggaaganaacgaacaacgt

SEQ ID NO: 554680 - DNA, 508 bp, Homo sapiens
  misc_feature: HIJSMM301AO58Q.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagccaaggctgccccctcggtcactctgtt

SEQ ID NO: 554681 - DNA, 503 bp, Homo sapiens
  misc_feature: HIJSMM301DEUQK.5.86.H09.1.454.light.4.raw
atcagacacgcacgaccggtgctcgatttagtgctatagacttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacatttgggtcgttataactatgtctcctggtaccaacacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagccaaggctgccccctcggtcta

SEQ ID NO: 554682 - DNA, 444 bp, Homo sapiens
  misc_feature: HIJSMM301A2VK1.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgtttcggcggcggaccaagttgaccgtcctacgtcagcccaaggctgccccctcggtcactctgttcccaccctcctcgacacgcgag

SEQ ID NO: 554683 - DNA, 493 bp, Homo sapiens; identical to SEQ ID NO: 535047
  misc_feature: HIJSMM301B7V25.16.53.E09.1.454.light.4.raw

SEQ ID NO: 554684 - DNA, 505 bp, Homo sapiens; identical to SEQ ID NO: 536254
  misc_feature: HIJSMM301BMGGP.7.71.G05.1.454.light.4.raw

SEQ ID NO: 554685 - DNA, 528 bp, Homo sapiens
  misc_feature: HIJSMM301DEY7B.49.21.B10.1.454.light.4.raw
agtcgagagacacgaccggtgctcgatttagtgtcgtcgcaagggggggtcgtcaggaggcagcgctcgcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattttgtctcctggtaccaacaccaccccagacaaagcccccagactcattatttatggtgtcggtgaccggccctcaggggtttcgaatcgcttctctggctccaagtccggctacacggcctccctgaccctctctgggctccaggccggacgaggctgattattactgcgcctcatatacaaaacaacaacatttgggtgttcggcggagggaccaagctgaccgtcctaggtcagcccaaggctgccccctcggtcactctgttcccaccctcctctctctcgact

SEQ ID NO: 554686 - DNA, 495 bp, Homo sapiens; identical to SEQ ID NO: 535821
  misc_feature: HIJSMM301BRYVB.3.31.C09.1.454.light.4.raw

SEQ ID NO: 554687 - DNA, 485 bp, Homo sapiens; identical to SEQ ID NO: 535606
  misc_feature: HIJSMM301B4IF1.47.46.E02.1.454.light.4.raw

SEQ ID NO: 554688 - DNA, 502 bp, Homo sapiens
  misc_feature: HIJSMM301D874I.43.34.D01.1.454.light.4.raw
  modified_base (193)..(193): a, c, t, g, unknown or other
tgtgagtagtcacgaccggtgctcgatttagatcgtctgtgttgggtttgggggtgggtagagaagacaggactcaggacaatctccagcatggccagcttccctctcctcctcaccctcctcactcactgtgcagggtcctgggcccagtctgtggtgactcagccaccctcagcgtctgggacccccgganagagggtcagcatctcctgttctggaagcagctccaacattggacgtaatactgtaaactggtaccagcaactcgcaggaacggccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaaggctgccccctcggt

SEQ ID NO: 554689 - DNA, 503 bp, Homo sapiens; identical to SEQ ID NO: 535044
  misc_feature: HIJSMM301AID73.19.78.H01.1.454.light.4.raw

SEQ ID NO: 554690 - DNA, 488 bp, Homo sapiens; identical to SEQ ID NO: 535081
  misc_feature: HIJSMM301AGYQ7.26.23.C01.1.454.light.4.raw

SEQ ID NO: 554691 - DNA, 488 bp, Homo sapiens
  misc_feature: HIJSMM301BHKQI.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtgcagtggatcatgcacagattttacactgaaaatcagcagagtggaggctgaggatgttgggctctattattgcatgcaagctctacaagtcccgctcacttttcggcggagggaccgaaggtggagatacaaacgaacg

SEQ ID NO: 554692 - DNA, 481 bp, Homo sapiens
  misc_feature: HIJSMM301CWR70.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccggtcctaggtcagcccaaggctgcccccc

SEQ ID NO: 554693 - DNA, 496 bp, Homo sapiens; identical to SEQ ID NO: 535660
  misc_feature: HIJSMM301DIMIC.43.25.C03.1.454.light.4.raw

SEQ ID NO: 554694 - DNA, 493 bp, Homo sapiens; identical to SEQ ID NO: 536471
  misc_feature: HIJSMM301DF1Z4.3.71.G05.1.454.light.4.raw

SEQ ID NO: 554695 - DNA, 511 bp, Homo sapiens
  misc_feature: HIJSMM301C94GJ.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaaggccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctct

SEQ ID NO: 554696 - DNA, 494 bp, Homo sapiens; identical to SEQ ID NO: 534992
  misc_feature: HIJSMM301BZ5LQ.9.1.A01.1.454.light.4.raw

SEQ ID NO: 554697 - DNA, 447 bp, Homo sapiens; identical to SEQ ID NO: 535020
  misc_feature: HIJSMM301DYECU.18.9.A09.1.454.light.4.raw

SEQ ID NO: 554698 - DNA, 484 bp, Homo sapiens; identical to SEQ ID NO: 537399
  misc_feature: HIJSMM301D4379.7.75.G09.1.454.light.4.raw

SEQ ID NO: 554699 - DNA, 504 bp, Homo sapiens; identical to SEQ ID NO: 539032
  misc_feature: HIJSMM301AT3W0.19.67.G01.1.454.light.4.raw

SEQ ID NO: 554700 - DNA, 525 bp, Homo sapiens
  misc_feature: HIJSMM301AJFFC.11.58.F03.1.454.light.4.raw
cgagagataccacgaccggtgctcgatttagtctgatcgagaagggaaagggggagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttggtaccgacagaccccaggccagcctccacgcacgctcatttataacacaaagactcgctcttctggggtccctaatcgcttctctggctccatccttgggaacaaagctgccctcaccatcacgggggcccaggcggacgatgaatctatttattattgtgtactttttgtgggtcgtggcatttctgctgtgttcggcggaggcacccaggtgaccgtcctcggtcagcccaaggctgcccccatcggtcactctgttcccaccct

SEQ ID NO: 554701 - DNA, 503 bp, Homo sapiens; identical to SEQ ID NO: 536834
  misc_feature: HIJSMM301AMOPH.2.35.D02.1.454.light.4.raw

SEQ ID NO: 554702 - DNA, 479 bp, Homo sapiens
  misc_feature: HIJSMM301CSDB4.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccgccctcctccgtgtctgat

SEQ ID NO: 554703 - DNA, 462 bp, Homo sapiens
  misc_feature: HIJSMM301AFG3T.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctcgccccctcggtcactctcgttcccaccctcctcacgcgtatgt

SEQ ID NO: 554704 - DNA, 507 bp, Homo sapiens; identical to SEQ ID NO: 541461
  misc_feature: HIJSMM301AZ2SN.11.57.F02.1.454.light.4.raw

SEQ ID NO: 554705 - DNA, 499 bp, Homo sapiens; identical to SEQ ID NO: 550763
  misc_feature: HIJSMM301CS07N.19.78.H01.1.454.light.4.raw

SEQ ID NO: 554706 - DNA, 505 bp, Homo sapiens; identical to SEQ ID NO: 535987
  misc_feature: HIJSMM301DGT71.18.37.D04.1.454.light.4.raw

SEQ ID NO: 554707 - DNA, 441 bp, Homo sapiens; identical to SEQ ID NO: 534971
  misc_feature: HIJSMM301CJXEY.11.3.A03.1.454.light.4.raw

SEQ ID NO: 554708 - DNA, 494 bp, Homo sapiens; identical to SEQ ID NO: 535629
  misc_feature: HIJSMM301AIXMG.4.27.C05.1.454.light.4.raw

SEQ ID NO: 554709 - DNA, 497 bp, Homo sapiens; identical to SEQ ID NO: 537288
  misc_feature: HIJSMM301A4NAZ.15.25.C03.1.454.light.4.raw

SEQ ID NO: 554710 - DNA, 486 bp, Homo sapiens; identical to SEQ ID NO: 535290
  misc_feature: HIJSMM301AZNTP.3.12.B01.1.454.light.4.raw

SEQ ID NO: 554711 - DNA, 502 bp, Homo sapiens
  misc_feature: HIJSMM301D24UC.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaacccactgtcactctcgtt

SEQ ID NO: 554712 - DNA, 494 bp, Homo sapiens; identical to SEQ ID NO: 535629
  misc_feature: HIJSMM301A76TV.4.27.C05.1.454.light.4.raw

SEQ ID NO: 554713 - DNA, 493 bp, Homo sapiens
  misc_feature: HIJSMM301ALFFE.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcgtcggagggaccgaaggcggagatcagacgaactagtggcgtgcaccactctgtcttcta

SEQ ID NO: 554714 - DNA, 489 bp, Homo sapiens
  misc_feature: HIJSMM301BUW2K.51.71.G05.1.454.light.4.raw
cgatcgtatacacgaccggtgctcgatttagtgtcgtcgcaagagagaggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcacg

SEQ ID NO: 554715 - DNA, 511 bp, Homo sapiens
  misc_feature: HIJSMM301AKUAS.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggtccaccgggaccgaacggtaggaaagtacaaacgaaactacgtggctgcaccatctgtctt

SEQ ID NO: 554716 - DNA, 479 bp, Homo sapiens
  misc_feature: HIJSMM301AYY6M.41.34.D01.1.454.light.4.raw
tctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaccat

SEQ ID NO: 554717 - DNA, 518 bp, Homo sapiens; identical to SEQ ID NO: 539372
  misc_feature: HIJSMM301DXAKR.7.86.H09.1.454.light.4.raw

SEQ ID NO: 554718 - DNA, 496 bp, Homo sapiens
  misc_feature: HIJSMM301B7BVM.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgccccctcggtcactctcg

SEQ ID NO: 554719 - DNA, 492 bp, Homo sapiens; identical to SEQ ID NO: 536010
  misc_feature: HIJSMM301CND87.10.20.B09.1.454.light.4.raw

SEQ ID NO: 554720 - DNA, 484 bp, Homo sapiens; identical to SEQ ID NO: 535400
  misc_feature: HIJSMM301CWZW1.46.26.C04.1.454.light.4.raw

SEQ ID NO: 554721 - DNA, 503 bp, Homo sapiens; identical to SEQ ID NO: 538884
  misc_feature: HIJSMM301EHEMM.27.78.H01.1.454.light.4.raw

SEQ ID NO: 554722 - DNA, 495 bp, Homo sapiens
  misc_feature: HIJSMM301CJXD0.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttt

SEQ ID NO: 554723 - DNA, 509 bp, Homo sapiens; identical to SEQ ID NO: 550053
  misc_feature: HIJSMM301AF7SG.8.33.C11.1.454.light.4.raw

SEQ ID NO: 554724 - DNA, 489 bp, Homo sapiens
  misc_feature: HIJSMM301C6EZT.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtgctgca

SEQ ID NO: 554725 - DNA, 507 bp, Homo sapiens
  misc_feature: HIJSMM301D9ZQ0.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcgccaacgggaccaaggtggaaatacaaacgaaactgtggctgcaccaatctcgtcttctatcttccccg

SEQ ID NO: 554726 - DNA, 494 bp, Homo sapiens
  misc_feature: HIJSMM301CAZBY.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacgatccgagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgttcggccgagggaccgaacggtacgaaataggagacgaacgtagtggtcgtgcaccaactctgttcc

SEQ ID NO: 554727 - DNA, 447 bp, Homo sapiens
  misc_feature: HIJSMM301BJID8.18.9.A09.1.454.light.4.raw
  modified_base (429)..(429): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatactcgta

SEQ ID NO: 554728 - DNA, 501 bp, Homo sapiens; identical to SEQ ID NO: 548645
  misc_feature: HIJSMM301BC9ZI.14.23.C01.1.454.light.4.raw

SEQ ID NO: 554729 - DNA, 508 bp, Homo sapiens
  misc_feature: HIJSMM301CVS3H.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtctacc

SEQ ID NO: 554730 - DNA, 497 bp, Homo sapiens
  misc_feature: HIJSMM301BUYB4.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttgggggtttattactgcatgcaaggtacacactggcccgtcaccttcggccaagggacacgactggagattaaacgaactgtggctgcacc

SEQ ID NO: 554731 - DNA, 509 bp, Homo sapiens; identical to SEQ ID NO: 549778
  misc_feature: HIJSMM301EB899.17.33.C11.1.454.light.4.raw

SEQ ID NO: 554732 - DNA, 455 bp, Homo sapiens
  misc_feature: HIJSMM301DGZFH.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcacgcccaaggctcgccccatcggtcactctcgttcccaccctcctctagtacgtga

SEQ ID NO: 554733 - DNA, 513 bp, Homo sapiens
  misc_feature: HIJSMM301EJ5R1.8.71.G05.1.454.light.4.raw
ctcgcgtgtccacgaccggtgctcgatttagtgtcgtcgcaagagagaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttctcgccatctgagacacgcgag

SEQ ID NO: 554734 - DNA, 444 bp, Homo sapiens; identical to SEQ ID NO: 544367
  misc_feature: HIJSMM301EFRIG.2.76.G10.1.454.light.4.raw

SEQ ID NO: 554735 - DNA, 499 bp, Homo sapiens; identical to SEQ ID NO: 536030
  misc_feature: HIJSMM301ASD2H.48.23.C01.1.454.light.4.raw

SEQ ID NO: 554736 - DNA, 460 bp, Homo sapiens; identical to SEQ ID NO: 536053
  misc_feature: HIJSMM301CXDQL.22.28.C06.1.454.light.4.raw

SEQ ID NO: 554737 - DNA, 505 bp, Homo sapiens
  misc_feature: HIJSMM301CF7TU.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 554738 - DNA, 494 bp, Homo sapiens; identical to SEQ ID NO: 535276
  misc_feature: HIJSMM301B01M0.16.6.A06.1.454.light.4.raw

SEQ ID NO: 554739 - DNA, 487 bp, Homo sapiens; identical to SEQ ID NO: 538190
  misc_feature: HIJSMM301A1HIF.47.70.G04.1.454.light.4.raw

SEQ ID NO: 554740 - DNA, 497 bp, Homo sapiens; identical to SEQ ID NO: 536807
  misc_feature: HIJSMM301CA0I2.10.37.D04.1.454.light.4.raw

SEQ ID NO: 554741 - DNA, 524 bp, Homo sapiens
  misc_feature: HIJSMM301C481R.40.27.C05.1.454.light.4.raw
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccaccctcctcagtcg

SEQ ID NO: 554742 - DNA, 502 bp, Homo sapiens
  misc_feature: HIJSMM301DKRRQ.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggaccaagctggagatcaaccgaactgtggctgcaccatctgtctt

SEQ ID NO: 554743 - DNA, 508 bp, Homo sapiens
  misc_feature: HIJSMM301D354K.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaaggtggaaagtacaaaacgaactagtggctgcaccatctgtcttcatcttccccg

SEQ ID NO: 554744 - DNA, 484 bp, Homo sapiens; identical to SEQ ID NO: 535400
  misc_feature: HIJSMM301BYDFB.46.26.C04.1.454.light.4.raw

SEQ ID NO: 554745 - DNA, 496 bp, Homo sapiens
  misc_feature: HIJSMM301CCMEE.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactggaccaaggtcaccgtctaggtcagcccaaggccaa

SEQ ID NO: 554746 - DNA, 471 bp, Homo sapiens
  misc_feature: HIJSMM301AKCN9.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccagggaccaagctggagatcagacg

SEQ ID NO: 554747 - DNA, 454 bp, Homo sapiens; identical to SEQ ID NO: 534964
  misc_feature: HIJSMM301D9GE1.19.86.H09.1.454.light.4.raw

SEQ ID NO: 554748 - DNA, 495 bp, Homo sapiens; identical to SEQ ID NO: 540838
  misc_feature: HIJSMM301AZRBG.14.64.F09.1.454.light.4.raw

SEQ ID NO: 554749 - DNA, 505 bp, Homo sapiens
  misc_feature: HIJSMM301DQURR.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccgccctcctctacgtcgtact

SEQ ID NO: 554750 - DNA, 485 bp, Homo sapiens
  misc_feature: HIJSMM301BABB9.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttacttctaccatcatcaacctgcagcctgaggatattgcaacatattactgtcaacaatatgataatctaccactcactttcggcggagggaccacggtggagatcaaacgaactagtggctgcaccatctgt

SEQ ID NO: 554751 - DNA, 488 bp, Homo sapiens; identical to SEQ ID NO: 535081
  misc_feature: HIJSMM301ATPJ7.26.23.C01.1.454.light.4.raw

SEQ ID NO: 554752 - DNA, 487 bp, Homo sapiens
  misc_feature: HIJSMM301CWF53.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccaggggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 554753 - DNA, 485 bp, Homo sapiens; identical to SEQ ID NO: 536723
  misc_feature: HIJSMM301BMU29.5.40.D07.1.454.light.4.raw

SEQ ID NO: 554754 - DNA, 476 bp, Homo sapiens
  misc_feature: HIJSMM301AYTY2.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccaaagtggatgtcaaccgaactgtggctgcacca

SEQ ID NO: 554755 - DNA, 503 bp, Homo sapiens
  misc_feature: HIJSMM301EZ68N.48.41.D08.1.454.light.4.raw
agtatacatacacgaccggtgctcgatttagtcacgcgagaaagggaaaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggggcgttcggtccaagggaccaaggtaggaaagtacaaacgaaacctagtggcgtg

SEQ ID NO: 554756 - DNA, 497 bp, Homo sapiens
  misc_feature: HIJSMM301CA17W.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcaccatctgtcttcatcttcccgccat

SEQ ID NO: 554757 - DNA, 404 bp, Homo sapiens; identical to SEQ ID NO: 535530
  misc_feature: HIJSMM301AYOBC.4.35.D02.1.454.light.4.raw

SEQ ID NO: 554758 - DNA, 472 bp, Homo sapiens
  misc_feature: HIJSMM301C6M15.51.1.A01.1.454.light.4.raw
cgatcgtatacacgaccggtgctcgatttagacgtctcatcaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcacttttcaccatcagcagactgcagcctgaagatattgcaacatattactgtcaacagtatgataatctcccgctcactttcggcggagggaccaaggtggggatcaaacgaactgtggc

SEQ ID NO: 554759 - DNA, 520 bp, Homo sapiens
  misc_feature: HIJSMM301C4LVW.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtt

SEQ ID NO: 554760 - DNA, 447 bp, Homo sapiens; identical to SEQ ID NO: 535020
  misc_feature: HIJSMM301B8SFD.18.9.A09.1.454.light.4.raw

SEQ ID NO: 554761 - DNA, 465 bp, Homo sapiens
  misc_feature: HIJSMM301BNM3I.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccactctgaagtatagtct

SEQ ID NO: 554762 - DNA, 447 bp, Homo sapiens; identical to SEQ ID NO: 535020
  misc_feature: HIJSMM301AIHWR.18.9.A09.1.454.light.4.raw

SEQ ID NO: 554763 - DNA, 484 bp, Homo sapiens; identical to SEQ ID NO: 535240
  misc_feature: HIJSMM301D9IG1.47.60.F05.1.454.light.4.raw

SEQ ID NO: 554764 - DNA, 494 bp, Homo sapiens
  misc_feature: HIJSMM301CVWEK.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcaccgtcaaggtcacg

SEQ ID NO: 554765 - DNA, 491 bp, Homo sapiens
  misc_feature: HIJSMM301ELW4A.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagccc

SEQ ID NO: 554766 - DNA, 482 bp, Homo sapiens; identical to SEQ ID NO: 538815
  misc_feature: HIJSMM301BZNXJ.4.34.D01.1.454.light.4.raw

SEQ ID NO: 554767 - DNA, 509 bp, Homo sapiens
  misc_feature: HIJSMM301DUQEF.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacattttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 554768 - DNA, 508 bp, Homo sapiens; identical to SEQ ID NO: 537871
  misc_feature: HIJSMM301CW4ZO.8.33.C11.1.454.light.4.raw

SEQ ID NO: 554769 - DNA, 506 bp, Homo sapiens; identical to SEQ ID NO: 535404
  misc_feature: HIJSMM301DWP9J.10.88.H11.1.454.light.4.raw

SEQ ID NO: 554770 - DNA, 489 bp, Homo sapiens; identical to SEQ ID NO: 553074
  misc_feature: HIJSMM301CFA7H.14.33.C11.1.454.light.4.raw

SEQ ID NO: 554771 - DNA, 505 bp, Homo sapiens; identical to SEQ ID NO: 543569
  misc_feature: HIJSMM301A9BKT.10.12.B01.1.454.light.4.raw

SEQ ID NO: 554772 - DNA, 490 bp, Homo sapiens
  misc_feature: HIJSMM301CIS93.52.81.H04.1.454.light.4.raw
cgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataattttgtgtcctggtaccagcaactcccaggcacagcccccaaactcctcatttatgacaatgataagcgaccctcagggatacctgaccgattctctggctccaagtctggcacgtcagccaccctgggcatcaccggactccagactggggacgaggccgattattactgcggaacatgggatagcagcctgagtgatgccagggtgttcggcggagggaccaagctgaccgtccg

SEQ ID NO: 554773 - DNA, 518 bp, Homo sapiens
  misc_feature: HIJSMM301B8VZE.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccgccctcctc

SEQ ID NO: 554774 - DNA, 489 bp, Homo sapiens; identical to SEQ ID NO: 535139
  misc_feature: HIJSMM301EUYXF.14.55.E11.1.454.light.4.raw

SEQ ID NO: 554775 - DNA, 500 bp, Homo sapiens; identical to SEQ ID NO: 540219
  misc_feature: HIJSMM301BB3HO.43.34.D01.1.454.light.4.raw

SEQ ID NO: 554776 - DNA, 518 bp, Homo sapiens
  misc_feature: HIJSMM301C9L3F.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctcctcactactca

SEQ ID NO: 554777 - DNA, 414 bp, Homo sapiens
  misc_feature: HIJSMM301BHUE4.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 554778 - DNA, 518 bp, Homo sapiens
  misc_feature: HIJSMM301DKTU8.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgccctccctcaccatctctggactgaagactgaggacgaggctgactactactgtcagtcttatgataacaccagggtggtgttcggcggagggaccaagctggccgtcctaggtcagcccaaggctgccccctcggtccactcctgttccccaccctcctcgagtagtaca

SEQ ID NO: 554779 - DNA, 485 bp, Homo sapiens
  misc_feature: HIJSMM301A3TJA.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtgctgcacc

SEQ ID NO: 554780 - DNA, 521 bp, Homo sapiens
  misc_feature: HIJSMM301BZDDY.5.27.C05.1.454.light.4.raw
  modified_base (384)..(384): a, c, t, g, unknown or other
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaanccggggatgaggccgactattactgtcaggtgtggaatggtgattatgattatgtcttcggaactgggaccaaggtcaccgtcctaggtcagcccaaggccaaccccactgtcactctgttccgccctcctccgtcg

SEQ ID NO: 554781 - DNA, 482 bp, Homo sapiens
  misc_feature: HIJSMM301B6LR1.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagtggccctcaggtattcctgagcgattctctggctccagttctgggaacacagccactctgaccatcagcgggacccaggctatggatgaggctgactattactgtcaggcgtgggacatcagcagtgaggtggttttcggcgggagggaccgaagctgaccgtcctaagtcacgcccaac

SEQ ID NO: 554782 - DNA, 487 bp, Homo sapiens
  misc_feature: HIJSMM301EJ4MV.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccat

SEQ ID NO: 554783 - DNA, 484 bp, Homo sapiens; identical to SEQ ID NO: 535240
  misc_feature: HIJSMM301BSJRH.47.60.F05.1.454.light.4.raw

SEQ ID NO: 554784 - DNA, 447 bp, Homo sapiens; identical to SEQ ID NO: 535020
  misc_feature: HIJSMM301CFKMK.18.9.A09.1.454.light.4.raw

SEQ ID NO: 554785 - DNA, 492 bp, Homo sapiens
  misc_feature: HIJSMM301CHQCA.10.72.G06.1.454.light.4.raw
catagtagtgcacgaccggtgctcgatttagctacgactgcaaggggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccagggggcactctcgtgatattcggcggagggacctggctgaccgtcctacgtcagcccaac

SEQ ID NO: 554786 - DNA, 509 bp, Homo sapiens
  misc_feature: HIJSMM301D3PUP.19.72.G06.1.454.light.4.raw
tactctcgtgcacgaccggtgctcgatttagctacgactgcaagggaaagggggggtcggcaagaggcagcgctctcgggacggtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcact

SEQ ID NO: 554787 - DNA, 488 bp, Homo sapiens; identical to SEQ ID NO: 535081
  misc_feature: HIJSMM301A8U17.26.23.C01.1.454.light.4.raw

SEQ ID NO: 554788 - DNA, 522 bp, Homo sapiens
  misc_feature: HIJSMM301CU8S5.27.23.C01.1.454.light.4.raw
  modified_base (518)..(518): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccnccct

SEQ ID NO: 554789 - DNA, 501 bp, Homo sapiens; identical to SEQ ID NO: 535746
  misc_feature: HIJSMM301ER12U.18.11.A11.1.454.light.4.raw

SEQ ID NO: 554790 - DNA, 485 bp, Homo sapiens; identical to SEQ ID NO: 536576
  misc_feature: HIJSMM301C92Y4.46.35.D02.1.454.light.4.raw

SEQ ID NO: 554791 - DNA, 491 bp, Homo sapiens
  misc_feature: HIJSMM301CTSBW.49.61.F06.1.454.light.4.raw
agtcgagagacacgaccggtgctcgatttagctacgctctaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtaccacaggattcactttcggccctgggaccagagtggatatcaaacgaactgtggctgcaccatctgtcttca

SEQ ID NO: 554792 - DNA, 422 bp, Homo sapiens; identical to SEQ ID NO: 538836
  misc_feature: HIJSMM301AL8R9.41.14.B03.1.454.light.4.raw

SEQ ID NO: 554793 - DNA, 508 bp, Homo sapiens
  misc_feature: HIJSMM301DYE9H.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtctaagtcagcccaaggctgccccctcggtcactctgttccca

SEQ ID NO: 554794 - DNA, 486 bp, Homo sapiens; identical to SEQ ID NO: 539294
  misc_feature: HIJSMM301D4SLX.12.33.C11.1.454.light.4.raw

SEQ ID NO: 554795 - DNA, 501 bp, Homo sapiens; identical to SEQ ID NO: 542101
  misc_feature: HIJSMM301DC39Z.14.57.F02.1.454.light.4.raw

SEQ ID NO: 554796 - DNA, 512 bp, Homo sapiens
  misc_feature: HIJSMM301BWFC1.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcct

SEQ ID NO: 554797 - DNA, 493 bp, Homo sapiens
  misc_feature: HIJSMM301AXMTJ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccaggggaccgaacggtaggaagtcaagcgaactgtggctgcaccatctgtt

SEQ ID NO: 554798 - DNA, 476 bp, Homo sapiens
  misc_feature: HIJSMM301CNU3U.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaactgtggctgcacca

SEQ ID NO: 554799 - DNA, 487 bp, Homo sapiens; identical to SEQ ID NO: 537220
  misc_feature: HIJSMM301ETLR3.16.53.E09.1.454.light.4.raw

SEQ ID NO: 554800 - DNA, 492 bp, Homo sapiens
  misc_feature: HIJSMM301BFCQ3.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctcttttattgggcatctgcccgggaatccggggtccctgaccgattcagtggcagcgggtctgggacagatttcactctcaccatcagcggcctgcaggctgaagatgtggcagtttattactgtcagcaattttatagtactccctggacgttcggccaagggaccaaggtggaaatcaaacgaactgtggctgcaccatctgtcttcatcttcccgccat

SEQ ID NO: 554801 - DNA, 492 bp, Homo sapiens
  misc_feature: HIJSMM301C5ZJQ.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagatttgcagtttattactgtcagcagtatgatacctggcctccgtacacttttggccggggaccaagctggaaatcaagcgaactgtggctgcaccatctgtcttcattcc

SEQ ID NO: 554802 - DNA, 512 bp, Homo sapiens; identical to SEQ ID NO: 551521
  misc_feature: HIJSMM301ASTG4.48.87.H10.1.454.light.4.raw

SEQ ID NO: 554803 - DNA, 447 bp, Homo sapiens; identical to SEQ ID NO: 535201
  misc_feature: HIJSMM301CS9O1.18.9.A09.1.454.light.4.raw

SEQ ID NO: 554804 - DNA, 492 bp, Homo sapiens; identical to SEQ ID NO: 534967
  misc_feature: HIJSMM301ESOII.47.64.F09.1.454.light.4.raw

SEQ ID NO: 554805 - DNA, 503 bp, Homo sapiens; identical to SEQ ID NO: 535453
  misc_feature: HIJSMM301DC9CI.8.28.C06.1.454.light.4.raw

SEQ ID NO: 554806 - DNA, 510 bp, Homo sapiens
  misc_feature: HIJSMM301CGWFM.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaaggctgaccgtcctaggtcagcccaaggctgccccctcggtcactctgttcccg

SEQ ID NO: 554807 - DNA, 496 bp, Homo sapiens; identical to SEQ ID NO: 553382
  misc_feature: HIJSMM301BPXTL.51.59.F04.1.454.light.4.raw

SEQ ID NO: 554808 - DNA, 515 bp, Homo sapiens
  misc_feature: HIJSMM301B2FK2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaagtcccggggtccctgaccgattcagtggcagcgggtctgggacagatttcactctcaccatcagcagcctgcaggctgaagatgtggcagtttattactgtcaactagttttctcgggtcgttcggccgaacgggaccgaaggtaggaaagtacaaacgaactagtggcgtgcaccatctgtcttctatcttccccg

SEQ ID NO: 554809 - DNA, 487 bp, Homo sapiens; identical to SEQ ID NO: 539157
  misc_feature: HIJSMM301COA0K.26.37.D04.1.454.light.4.raw

SEQ ID NO: 554810 - DNA, 483 bp, Homo sapiens; identical to SEQ ID NO: 535413
  misc_feature: HIJSMM301CNXFE.26.78.H01.1.454.light.4.raw

SEQ ID NO: 554811 - DNA, 505 bp, Homo sapiens
  misc_feature: HIJSMM301DD6LO.11.57.F02.1.454.light.4.raw
  modified_base (468)..(468): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggaccagtggaagtcgaancgaactgtggctgcaccatctgtcttcatctcccgcc

SEQ ID NO: 554812 - DNA, 494 bp, Homo sapiens; identical to SEQ ID NO: 534994
  misc_feature: HIJSMM301BGWDL.27.78.H01.1.454.light.4.raw

SEQ ID NO: 554813 - DNA, 496 bp, Homo sapiens
  misc_feature: HIJSMM301D24F7.40.22.B11.1.454.light.4.raw
tctagcgactcacgaccggtgctcgatttagacgacagctcagggcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccgaaggaccgaaa

SEQ ID NO: 554814 - DNA, 472 bp, Homo sapiens
  misc_feature: HIJSMM301C9OHY.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactggagattaacgaa

SEQ ID NO: 554815 - DNA, 503 bp, Homo sapiens
  misc_feature: HIJSMM301APCQJ.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaacgggaccgaacggtaggaaagtacaaacgaaacctagtggcgtgcaccatctgtt

SEQ ID NO: 554816 - DNA, 488 bp, Homo sapiens; identical to SEQ ID NO: 553834
  misc_feature: HIJSMM301ADNC7.17.35.D02.1.454.light.4.raw

SEQ ID NO: 554817 - DNA, 465 bp, Homo sapiens
  misc_feature: HIJSMM301BNSVV.18.59.F04.1.454.light.4.raw
tacgagtatgcacgaccggtgctcgatttagtacacacacttagggattgggggctttgcctgggtccttgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 554818 - DNA, 480 bp, Homo sapiens; identical to SEQ ID NO: 535442
  misc_feature: HIJSMM301BRSOQ.41.17.B06.1.454.light.4.raw

SEQ ID NO: 554819 - DNA, 518 bp, Homo sapiens; identical to SEQ ID NO: 539372
  misc_feature: HIJSMM301DOPST.7.86.H09.1.454.light.4.raw

SEQ ID NO: 554820 - DNA, 478 bp, Homo sapiens
  misc_feature: HIJSMM301BN8SE.12.28.C06.1.454.light.4.raw
  modified_base (439)..(439): a, c, t, g, unknown or other
  modified_base (461)..(461): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtgcncgggacgaccgacgagaaatanaagacgaacgatgcgtg

SEQ ID NO: 554821 - DNA, 481 bp, Homo sapiens; identical to SEQ ID NO: 542530
  misc_feature: HIJSMM301B3C9F.4.74.G08.1.454.light.4.raw

SEQ ID NO: 554822 - DNA, 494 bp, Homo sapiens
  misc_feature: HIJSMM301CB50Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgattccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 554823 - DNA, 502 bp, Homo sapiens; identical to SEQ ID NO: 536253
  misc_feature: HIJSMM301ANCDN.21.22.B11.1.454.light.4.raw

SEQ ID NO: 554824 - DNA, 484 bp, Homo sapiens; identical to SEQ ID NO: 549734
  misc_feature: HIJSMM301ENT30.49.60.F05.1.454.light.4.raw

SEQ ID NO: 554825 - DNA, 497 bp, Homo sapiens; identical to SEQ ID NO: 535740
  misc_feature: HIJSMM301DCNSU.3.71.G05.1.454.light.4.raw

SEQ ID NO: 554826 - DNA, 513 bp, Homo sapiens; identical to SEQ ID NO: 535244
  misc_feature: HIJSMM301D8M5C.17.33.C11.1.454.light.4.raw

SEQ ID NO: 554827 - DNA, 494 bp, Homo sapiens; identical to SEQ ID NO: 536974
  misc_feature: HIJSMM301DDTLD.16.86.H09.1.454.light.4.raw

SEQ ID NO: 554828 - DNA, 487 bp, Homo sapiens; identical to SEQ ID NO: 537573
  misc_feature: HIJSMM301A7JZT.3.10.A10.1.454.light.4.raw

SEQ ID NO: 554829 - DNA, 496 bp, Homo sapiens; identical to SEQ ID NO: 537925
  misc_feature: HIJSMM301DPFYE.22.14.B03.1.454.light.4.raw

SEQ ID NO: 554830 - DNA, 529 bp, Homo sapiens
  misc_feature: HIJSMM301E04WS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgacgggaccgaacggtaggaaggtacgtaaacgaaaccgtagtaggcgtgcgaccactctcgtcttctactcttcccgtccctact

SEQ ID NO: 554831 - DNA, 497 bp, Homo sapiens
  misc_feature: HIJSMM301ARBVA.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcta

SEQ ID NO: 554832 - DNA, 484 bp, Homo sapiens; identical to SEQ ID NO: 535400
  misc_feature: HIJSMM301B7I1S.46.26.C04.1.454.light.4.raw

SEQ ID NO: 554833 - DNA, 485 bp, Homo sapiens; identical to SEQ ID NO: 538533
  misc_feature: HIJSMM301DZ8ZQ.47.78.H01.1.454.light.4.raw

SEQ ID NO: 554834 - DNA, 503 bp, Homo sapiens; identical to SEQ ID NO: 537226
  misc_feature: HIJSMM301B54A8.19.85.H08.1.454.light.4.raw

SEQ ID NO: 554835 - DNA, 520 bp, Homo sapiens; identical to SEQ ID NO: 537173
  misc_feature: HIJSMM301C67IE.27.23.C01.1.454.light.4.raw

SEQ ID NO: 554836 - DNA, 510 bp, Homo sapiens
  misc_feature: HIJSMM301ASERV.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaaggctgaccgtcctaggtcagcccaaggctgccccctcggtcta

SEQ ID NO: 554837 - DNA, 497 bp, Homo sapiens; identical to SEQ ID NO: 535664
  misc_feature: HIJSMM301DQX9Q.22.14.B03.1.454.light.4.raw

SEQ ID NO: 554838 - DNA, 497 bp, Homo sapiens
  misc_feature: HIJSMM301D14LL.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggcccaagggaccaaggtggaaatcaaacgaactgtggctgcacc

SEQ ID NO: 554839 - DNA, 501 bp, Homo sapiens
  misc_feature: HIJSMM301B2D5I.17.33.C11.1.454.light.4.raw
  modified_base (432)..(432): a, c, t, g, unknown or other
  modified_base (435)..(435): a, c, t, g, unknown or other
  modified_base (452)..(452): a, c, t, g, unknown or other
  modified_base (472)..(472): a, c, t, g, unknown or other
  modified_base (489)..(489): a, c, t, g, unknown or other
  modified_base (494)..(494): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaaacaacaaacactcctggacccctgcccgattctcaggctccctccttgggggcaaagctgccctgacactgtctggtgtgcaagcctgaggacgaggctgactattactgctactctactttgtgtggcntgnattgcggaggacaagcnacgcttagtcagcccaagcngcccctccggtcactcnttccnccctcct

SEQ ID NO: 554840 - DNA, 472 bp, Homo sapiens
  misc_feature: HIJSMM301AD8TW.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggtaccgaaggtggacatcaaacga

SEQ ID NO: 554841 - DNA, 510 bp, Homo sapiens
  misc_feature: HIJSMM301CAF1Q.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggacgaacgtaggaagtcaacgaactagtggcgtgcaccactctgtcttctactcttcccgtcccact

SEQ ID NO: 554842 - DNA, 504 bp, Homo sapiens; identical to SEQ ID NO: 535128
  misc_feature: HIJSMM301AM5NC.19.85.H08.1.454.light.4.raw

SEQ ID NO: 554843 - DNA, 489 bp, Homo sapiens; identical to SEQ ID NO: 536663
  misc_feature: HIJSMM301DRAEQ.16.72.G06.1.454.light.4.raw

SEQ ID NO: 554844 - DNA, 501 bp, Homo sapiens
  misc_feature: HIJSMM301DX5J5.9.71.G05.1.454.light.4.raw
  modified_base (483)..(483): a, c, t, g, unknown or other
tgatacgtctcacgaccggtgctcgatttagtgtcgtcgcaagagagaggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccnccctcctcagacgtatca

SEQ ID NO: 554845 - DNA, 488 bp, Homo sapiens; identical to SEQ ID NO: 545695
  misc_feature: HIJSMM301CMLZ4.46.26.C04.1.454.light.4.raw

SEQ ID NO: 554846 - DNA, 489 bp, Homo sapiens; identical to SEQ ID NO: 535091
  misc_feature: HIJSMM301BDYU4.47.36.D03.1.454.light.4.raw

SEQ ID NO: 554847 - DNA, 489 bp, Homo sapiens; identical to SEQ ID NO: 535139
  misc_feature: HIJSMM301DU95L.14.55.E11.1.454.light.4.raw

SEQ ID NO: 554848 - DNA, 527 bp, Homo sapiens
  misc_feature: HIJSMM301CA641.27.23.C01.1.454.light.4.raw
  modified_base (520)..(520): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgtcctaggtcagcccaaggctgccccctccggtcactctgttcccnccctcct

SEQ ID NO: 554849 - DNA, 498 bp, Homo sapiens; identical to SEQ ID NO: 535295
  misc_feature: HIJSMM301DWPNK.15.25.C03.1.454.light.4.raw

SEQ ID NO: 554850 - DNA, 486 bp, Homo sapiens
  misc_feature: HIJSMM301ANLCK.41.72.G06.1.454.light.4.raw
tctatactatcacgaccggtgctcgatttagctacgactgcaagggaaaggggaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagccc

SEQ ID NO: 554851 - DNA, 509 bp, Homo sapiens; identical to SEQ ID NO: 539359
  misc_feature: HIJSMM301ELCTA.47.85.H08.1.454.light.4.raw

SEQ ID NO: 554852 - DNA, 486 bp, Homo sapiens; identical to SEQ ID NO: 540090
  misc_feature: HIJSMM301CGBTQ.17.36.D03.1.454.light.4.raw

SEQ ID NO: 554853 - DNA, 510 bp, Homo sapiens
  misc_feature: HIJSMM301AE4WH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggacgaaggtaggagtacaacgaactagtggcgtgcaccactctcgtcttctactcttcccgtccctact

SEQ ID NO: 554854 - DNA, 383 bp, Homo sapiens; identical to SEQ ID NO: 447524
  misc_feature: HIJSMM301EVO3Y.41.26.C04.1.454.light.4.raw

SEQ ID NO: 554855 - DNA, 510 bp, Homo sapiens
  misc_feature: HIJSMM301CV647.3.37.D04.1.454.light.4.raw
agacgcactccacgaccggtgctcgatttagtagcatactgttgggtttggggggggtcgtcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtca

SEQ ID NO: 554856 - DNA, 494 bp, Homo sapiens; identical to SEQ ID NO: 534992
  misc_feature: HIJSMM301DJ47Z.9.1.A01.1.454.light.4.raw

SEQ ID NO: 554857 - DNA, 503 bp, Homo sapiens
  misc_feature: HIJSMM301CFWNS.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaagggaccgaacggtggaaagtcaagcgaactgtggctgcaccactctgtcttctatt

SEQ ID NO: 554858 - DNA, 486 bp, Homo sapiens; identical to SEQ ID NO: 535043
  misc_feature: HIJSMM301BYIVR.46.35.D02.1.454.light.4.raw

SEQ ID NO: 554859 - DNA, 488 bp, Homo sapiens; identical to SEQ ID NO: 543444
  misc_feature: HIJSMM301BNTUY.51.29.C07.1.454.light.4.raw

SEQ ID NO: 554860 - DNA, 475 bp, Homo sapiens; identical to SEQ ID NO: 537714
  misc_feature: HIJSMM301BYQLC.7.81.H04.1.454.light.4.raw

SEQ ID NO: 554861 - DNA, 474 bp, Homo sapiens; identical to SEQ ID NO: 538184
  misc_feature: HIJSMM301CD2Y4.13.76.G10.1.454.light.4.raw

SEQ ID NO: 554862 - DNA, 506 bp, Homo sapiens
  misc_feature: HIJSMM301DGSLQ.8.28.C06.1.454.light.4.raw
ctcgcgtgtccacgaccggtgctcgatttagagctcacgtattgggtttgggggaggaactgctcagttaggacccagacggaaccatggaagccccagcgaagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggaggaccaaggtggacctcaaacgaactgtggctgcaccatctgtcttcatcttcccgccat

SEQ ID NO: 554863 - DNA, 488 bp, Homo sapiens
  misc_feature: HIJSMM301ER8X8.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaaggaccaagctggagatcaaacgaactgtggctgcacca

SEQ ID NO: 554864 - DNA, 486 bp, Homo sapiens; identical to SEQ ID NO: 535043
  misc_feature: HIJSMM301BFTRC.46.35.D02.1.454.light.4.raw

SEQ ID NO: 554865 - DNA, 496 bp, Homo sapiens; identical to SEQ ID NO: 546893
  misc_feature: HIJSMM301BPHW2.51.35.D02.1.454.light.4.raw

SEQ ID NO: 554866 - DNA, 486 bp, Homo sapiens; identical to SEQ ID NO: 537144
  misc_feature: HIJSMM301DN6H4.46.35.D02.1.454.light.4.raw

SEQ ID NO: 554867 - DNA, 509 bp, Homo sapiens
  misc_feature: HIJSMM301D086C.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttcctaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactagtggctgcaccatctgtt

SEQ ID NO: 554868 - DNA, 493 bp, Homo sapiens
  misc_feature: HIJSMM301CG4AF.3.35.D02.1.454.light.4.raw
agacgcactccacgaccggtgctcgatttagcacacgatagttgggtttgggggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagtcagactgttagcaccaacttagcctggtatcagcagaaacctggccagtctcccaggctcctcatctatggtgcatccaccagggcccctggtgtcccagccaggttcagtggcagtgggtctgggacagagttcactctcaccatcagcggcctgcagtctgaagattttgcagtttattactgtcagcagtataattactggccgccgacgttcgccaagggaccaaggtggaaatcaaacgaactagtggctgcaccatctgtcttcat

SEQ ID NO: 554869 - DNA, 463 bp, Homo sapiens; identical to SEQ ID NO: 535062
  misc_feature: HIJSMM301BL2YF.11.73.G07.1.454.light.4.raw

SEQ ID NO: 554870 - DNA, 504 bp, Homo sapiens
  misc_feature: HIJSMM301C47E3.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacggttcggcggacggaccgaggtggacatacaaacgactgtgctgcaccatctgtcttcatccttcccg

SEQ ID NO: 554871 - DNA, 482 bp, Homo sapiens; identical to SEQ ID NO: 535920
  misc_feature: HIJSMM301EG9RI.19.71.G05.1.454.light.4.raw

SEQ ID NO: 554872 - DNA, 499 bp, Homo sapiens
  misc_feature: HIJSMM301A2KH3.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 554873 - DNA, 498 bp, Homo sapiens
  misc_feature: HIJSMM301EV4TM.43.25.C03.1.454.light.4.raw
tgtgagtagtcacgaccggtgctcgatttagtagtgtagatttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcaccatctgt

SEQ ID NO: 554874 - DNA, 471 bp, Homo sapiens
  misc_feature: HIJSMM301ELIQG.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcgcgggggaccaaggtggagatcaaacgaa

SEQ ID NO: 554875 - DNA, 495 bp, Homo sapiens
  misc_feature: HIJSMM301D13MQ.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctcacgtcg

SEQ ID NO: 554876 - DNA, 490 bp, Homo sapiens
  misc_feature: HIJSMM301EPEVE.5.47.E03.1.454.light.4.raw
atcagacacgcacgaccggtgctcgatttagactcgcgcacagagagaagggggaagagctgctcagttagggcccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacaggacttcactctcaccatcagcagactggagcctgaagattttgcagtgtattactgtcagcagtatgggctctcacctttcactttcggcggagggaccaaggtggagaacaaacgaactgtggctgcaccat

SEQ ID NO: 554877 - DNA, 504 bp, Homo sapiens; identical to SEQ ID NO: 535561
  misc_feature: HIJSMM301DV2H7.4.57.F02.1.454.light.4.raw

SEQ ID NO: 554878 - DNA, 492 bp, Homo sapiens
  misc_feature: HIJSMM301EP39F.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagtcgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 554879 - DNA, 354 bp, Homo sapiens; identical to SEQ ID NO: 535026
  misc_feature: HIJSMM301CVVBS.19.22.B11.1.454.light.4.raw

SEQ ID NO: 554880 - DNA, 518 bp, Homo sapiens
  misc_feature: HIJSMM301CP1SN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacgtcctaggtcagccaaggctgccccctcggtcactctgttccaccct

SEQ ID NO: 554881 - DNA, 470 bp, Homo sapiens; identical to SEQ ID NO: 535302
  misc_feature: HIJSMM301BQHYM.13.76.G10.1.454.light.4.raw

SEQ ID NO: 554882 - DNA, 517 bp, Homo sapiens
  misc_feature: HIJSMM301CT68L.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgccctctcacg

SEQ ID NO: 554883 - DNA, 509 bp, Homo sapiens
  misc_feature: HIJSMM301ALSTL.10.71.G05.1.454.light.4.raw
catagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttctatcttccccg

SEQ ID NO: 554884 - DNA, 480 bp, Homo sapiens; identical to SEQ ID NO: 535630
  misc_feature: HIJSMM301AZZZK.40.59.F04.1.454.light.4.raw

SEQ ID NO: 554885 - DNA, 496 bp, Homo sapiens
  misc_feature: HIJSMM301EKQ6X.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggcctcagggtccctgatcgcttctctggctccaagtctggcaacacggcctccctgaccatctctgggctccaggctgaagatgaggctgattattactgctgctcatttgcaggcgcctacacgttgggtggttcggcggagggaccaagctgaccgtcctaggtcagcccaaggctgccccctcggtcactctgtcccaccctctcg

SEQ ID NO: 554886 - DNA, 498 bp, Homo sapiens
  misc_feature: HIJSMM301AOOFR.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggt

SEQ ID NO: 554887 - DNA, 509 bp, Homo sapiens; identical to SEQ ID NO: 539359
  misc_feature: HIJSMM301CZW5J.47.85.H08.1.454.light.4.raw

SEQ ID NO: 554888 - DNA, 354 bp, Homo sapiens; identical to SEQ ID NO: 540485
  misc_feature: HIJSMM301A8FW4.40.9.A09.1.454.light.4.raw

SEQ ID NO: 554889 - DNA, 511 bp, Homo sapiens
  misc_feature: HIJSMM301AO9VG.43.67.G01.1.454.light.4.raw
tgtgagtagtcacgaccggtgctcgatttagagtatacatattgggtttggggggccgttgcattgtgaactgagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaatcaaacgaactgtgg

SEQ ID NO: 554890 - DNA, 460 bp, Homo sapiens; identical to SEQ ID NO: 539553
  misc_feature: HIJSMM301C4C3Y.11.86.H09.1.454.light.4.raw

SEQ ID NO: 554891 - DNA, 516 bp, Homo sapiens
  misc_feature: HIJSMM301AVBW2.41.35.D02.1.454.light.4.raw
tctatactatcacgaccggtgctcgatttagcacacgatagttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttccca

SEQ ID NO: 554892 - DNA, 487 bp, Homo sapiens
  misc_feature: HIJSMM301ERSB0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 554893 - DNA, 506 bp, Homo sapiens
  misc_feature: HIJSMM301B7CZJ.48.68.G02.1.454.light.4.raw
agtatacatacacgaccggtgctcgatttagtcgatagtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactagtggctgcaccatctgtt

SEQ ID NO: 554894 - DNA, 495 bp, Homo sapiens
  misc_feature: HIJSMM301C7Q7C.13.39.D06.1.454.light.4.raw
tcacgtactacacgaccggtgctcgatttagtgacatctcgcagttctttgggggctacaacaggcaggaaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 554895 - DNA, 486 bp, Homo sapiens; identical to SEQ ID NO: 535290
  misc_feature: HIJSMM301AMJOE.3.12.B01.1.454.light.4.raw

SEQ ID NO: 554896 - DNA, 509 bp, Homo sapiens; identical to SEQ ID NO: 540854
  misc_feature: HIJSMM301BZMKA.4.71.G05.1.454.light.4.raw

SEQ ID NO: 554897 - DNA, 511 bp, Homo sapiens; identical to SEQ ID NO: 537464
  misc_feature: HIJSMM301DVF6Q.7.34.D01.1.454.light.4.raw

SEQ ID NO: 554898 - DNA, 447 bp, Homo sapiens; identical to SEQ ID NO: 535201
  misc_feature: HIJSMM301AJDTC.18.9.A09.1.454.light.4.raw

SEQ ID NO: 554899 - DNA, 487 bp, Homo sapiens; identical to SEQ ID NO: 551272
  misc_feature: HIJSMM301DED4Q.4.59.F04.1.454.light.4.raw

SEQ ID NO: 554900 - DNA, 489 bp, Homo sapiens
  misc_feature: HIJSMM301BYS4N.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgatgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtctt

SEQ ID NO: 554901 - DNA, 485 bp, Homo sapiens; identical to SEQ ID NO: 536576
  misc_feature: HIJSMM301CXGZJ.46.35.D02.1.454.light.4.raw

SEQ ID NO: 554902 - DNA, 422 bp, Homo sapiens; identical to SEQ ID NO: 447881
  misc_feature: HIJSMM301ASSCG.9.34.D01.1.454.light.4.raw

SEQ ID NO: 554903 - DNA, 485 bp, Homo sapiens
  misc_feature: HIJSMM301ARHKS.3.5.A05.1.454.light.4.raw
agacgcactccacgaccggtgctcgatttagatagatagacaggggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgccgcacgtttggccaggggaccgaaggtagagatcaaacgaactagtggctgcaccatctgt

SEQ ID NO: 554904 - DNA, 448 bp, Homo sapiens
  misc_feature: HIJSMM301AXKKT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctcccatactcgta

SEQ ID NO: 554905 - DNA, 502 bp, Homo sapiens; identical to SEQ ID NO: 543913
  misc_feature: HIJSMM301EDGNL.18.26.C04.1.454.light.4.raw

SEQ ID NO: 554906 - DNA, 488 bp, Homo sapiens; identical to SEQ ID NO: 537124
  misc_feature: HIJSMM301BGHXZ.11.25.C03.1.454.light.4.raw

SEQ ID NO: 554907 - DNA, 509 bp, Homo sapiens; identical to SEQ ID NO: 539359
  misc_feature: HIJSMM301DJY1N.47.85.H08.1.454.light.4.raw

SEQ ID NO: 554908 - DNA, 488 bp, Homo sapiens; identical to SEQ ID NO: 542699
  misc_feature: HIJSMM301AF9IR.12.51.E07.1.454.light.4.raw

SEQ ID NO: 554909 - DNA, 485 bp, Homo sapiens; identical to SEQ ID NO: 536075
  misc_feature: HIJSMM301DNYTQ.17.21.B10.1.454.light.4.raw

SEQ ID NO: 554910 - DNA, 463 bp, Homo sapiens
  misc_feature: HIJSMM301DFN22.13.4.A04.1.454.light.4.raw
  modified_base (453)..(453): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctccgatcaccttcggccaaggcacgactgganattaaacgaa

SEQ ID NO: 554911 - DNA, 500 bp, Homo sapiens; identical to SEQ ID NO: 539362
  misc_feature: HIJSMM301DUKEH.26.26.C04.1.454.light.4.raw

SEQ ID NO: 554912 - DNA, 513 bp, Homo sapiens; identical to SEQ ID NO: 535719
  misc_feature: HIJSMM301EWJV0.17.33.C11.1.454.light.4.raw

SEQ ID NO: 554913 - DNA, 506 bp, Homo sapiens; identical to SEQ ID NO: 539721
  misc_feature: HIJSMM301EXJNH.3.79.H02.1.454.light.4.raw

SEQ ID NO: 554914 - DNA, 487 bp, Homo sapiens
  misc_feature: HIJSMM301EZM2U.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgtaggtctagtcagagcctcctgcatagtaatggatacaactatttggattggtacctgcagaagccagggcagtctccacagctcctgatctatttgggttctaatcgggcctccgggtccctgacaggttcagtggcagtggatcaggcacagattttacactgaaaatcagcagagtggaggctgaggatgttggggtttattactgcatgcaagctctacaaactccttacacttttggccagggggaccaagctggagatcaaacgaa

SEQ ID NO: 554915 - DNA, 469 bp, Homo sapiens
  misc_feature: HIJSMM301CJNKF.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccaaggtggacatcaacgaa

SEQ ID NO: 554916 - DNA, 490 bp, Homo sapiens
  misc_feature: HIJSMM301BZ72Q.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcggaccaagttgaccgtcctacg

SEQ ID NO: 554917 - DNA, 449 bp, Homo sapiens
  misc_feature: HIJSMM301EQ3E6.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacacgtaccccaaacccctcatctatggtaatagtaatcggccctcgacggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctcgccccctcggtcactctgttcccgccctcctcagacgtatca

SEQ ID NO: 554918 - DNA, 488 bp, Homo sapiens; identical to SEQ ID NO: 542699
  misc_feature: HIJSMM301CVHBD.12.51.E07.1.454.light.4.raw

SEQ ID NO: 554919 - DNA, 502 bp, Homo sapiens
  misc_feature: HIJSMM301BEWHY.19.67.G01.1.454.light.4.raw
tactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcgccaagggaccagggtggaaatcagacgaactgtgggctgcaccat

SEQ ID NO: 554920 - DNA, 445 bp, Homo sapiens; identical to SEQ ID NO: 542143
  misc_feature: HIJSMM301DSOGT.47.85.H08.1.454.light.4.raw

SEQ ID NO: 554921 - DNA, 484 bp, Homo sapiens
  misc_feature: HIJSMM301DUOF1.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgctaacttactactgtcaacagagtttcactacccctctcactttcggcgggggaccaaggtggagatcaaacgaactgtggctgcaccta

SEQ ID NO: 554922 - DNA, 469 bp, Homo sapiens; identical to SEQ ID NO: 536091
  misc_feature: HIJSMM301BMVEX.3.82.H05.1.454.light.4.raw

SEQ ID NO: 554923 - DNA, 488 bp, Homo sapiens; identical to SEQ ID NO: 536861
  misc_feature: HIJSMM301C8D1A.12.88.H11.1.454.light.4.raw

SEQ ID NO: 554924 - DNA, 516 bp, Homo sapiens
  misc_feature: HIJSMM301AF0IQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccgaacgggaccgaacggtaggaaagtacaaacgaacctagtggctgcaccactctgtcttctatcttccccg

SEQ ID NO: 554925 - DNA, 503 bp, Homo sapiens
  misc_feature: HIJSMM301EO53G.17.10.A10.1.454.light.4.raw
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccatgttggattcaattatgtgtcctggtaccagcaactcccgggatcagcccccaaacctcctcatatatgaagataataagcgaccctcaggggtcctttgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctccg

SEQ ID NO: 554926 - DNA, 502 bp, Homo sapiens; identical to SEQ ID NO: 538778
  misc_feature: HIJSMM301CZPU1.19.67.G01.1.454.light.4.raw

SEQ ID NO: 554927 - DNA, 454 bp, Homo sapiens; identical to SEQ ID NO: 534964
  misc_feature: HIJSMM301CEEXL.19.86.H09.1.454.light.4.raw

SEQ ID NO: 554928 - DNA, 486 bp, Homo sapiens; identical to SEQ ID NO: 535290
  misc_feature: HIJSMM301CGT4J.3.12.B01.1.454.light.4.raw

SEQ ID NO: 554929 - DNA, 482 bp, Homo sapiens
  misc_feature: HIJSMM301ASFTM.46.35.D02.1.454.light.4.raw
  modified_base (196)..(196): a, c, t, g, unknown or other
  modified_base (206)..(206): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctntcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggaccaagctggagatcaaacgactgtggctgcacat

SEQ ID NO: 554930 - DNA, 486 bp, Homo sapiens
  misc_feature: HIJSMM301A9FBQ.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctcctacgtgagct

SEQ ID NO: 554931 - DNA, 498 bp, Homo sapiens
  misc_feature: HIJSMM301C0CMA.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgccact

SEQ ID NO: 554932 - DNA, 487 bp, Homo sapiens; identical to SEQ ID NO: 539104
  misc_feature: HIJSMM301A3J2S.17.57.F02.1.454.light.4.raw

SEQ ID NO: 554933 - DNA, 484 bp, Homo sapiens
  misc_feature: HIJSMM301AYGCE.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcccaacttattactgtctacaagattacacttaccctgggacgttcggccaagggaccaaggtggaaatacaaacgaactagtggctgcacca

SEQ ID NO: 554934 - DNA, 490 bp, Homo sapiens; identical to SEQ ID NO: 535420
  misc_feature: HIJSMM301D8KKE.3.72.G06.1.454.light.4.raw

SEQ ID NO: 554935 - DNA, 492 bp, Homo sapiens
  misc_feature: HIJSMM301A5EOI.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagtattttgctaatttattactgtcagcagtataataactggtggacgttcggccaagggaccaaggtagaaatacaaacgaactagtggctgcaccatctgtt

SEQ ID NO: 554936 - DNA, 485 bp, Homo sapiens; identical to SEQ ID NO: 535606
  misc_feature: HIJSMM301CN7AE.47.46.E02.1.454.light.4.raw

SEQ ID NO: 554937 - DNA, 497 bp, Homo sapiens
  misc_feature: HIJSMM301B4BWX.14.64.F09.1.454.light.4.raw
  modified_base (475)..(475): a, c, t, g, unknown or other
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaactagagttatgataccccgtggacgttcggcagggaccgaaggtgaaggatcaaacgaaactagtggctgnaccatctgtcttcatcttcccg

SEQ ID NO: 554938 - DNA, 377 bp, Homo sapiens; identical to SEQ ID NO: 536071
  misc_feature: HIJSMM301CLTS0.40.9.A09.1.454.light.4.raw

SEQ ID NO: 554939 - DNA, 489 bp, Homo sapiens
  misc_feature: HIJSMM301D9HD8.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatccactttcggccaagggacacgaccgcagattggacgaactgtggctgcacc

SEQ ID NO: 554940 - DNA, 495 bp, Homo sapiens
  misc_feature: HIJSMM301DWYF5.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggccttcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctggtcactctgttccca

SEQ ID NO: 554941 - DNA, 475 bp, Homo sapiens
  misc_feature: HIJSMM301CSWUG.12.49.E05.1.454.light.4.raw
  modified_base (439)..(439): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtacaaaagtataacagtgcccccttnaccttcggccaagggacacgactggagattagaacg

SEQ ID NO: 554942 - DNA, 490 bp, Homo sapiens; identical to SEQ ID NO: 535064
  misc_feature: HIJSMM301AT7GV.10.72.G06.1.454.light.4.raw

SEQ ID NO: 554943 - DNA, 511 bp, Homo sapiens; identical to SEQ ID NO: 535406
  misc_feature: HIJSMM301E0MXE.43.59.F04.1.454.light.4.raw

SEQ ID NO: 554944 - DNA, 484 bp, Homo sapiens; identical to SEQ ID NO: 538770
  misc_feature: HIJSMM301D3ONS.4.57.F02.1.454.light.4.raw

SEQ ID NO: 554945 - DNA, 510 bp, Homo sapiens
  misc_feature: HIJSMM301BK69L.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctcctgaccatctctgggctccaggctgaggacgaggctgattattactgcaactcacttacaacgaccgacacttgcgtattcggcggcgggaccaagctgaccgtcctaggtcagcccaaggctgccccctcggtcact

SEQ ID NO: 554946 - DNA, 443 bp, Homo sapiens
  misc_feature: HIJSMM301DS9E0.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctggtcactctgttcccaccctcctccgtgtctgat

SEQ ID NO: 554947 - DNA, 522 bp, Homo sapiens
  misc_feature: HIJSMM301CD930.27.23.C01.1.454.light.4.raw
  modified_base (448)..(448): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggngttcggcggagggaccaggctgaccgtcctaggtcagcccaaggctgccccctcggtcactctgttcccaccct

SEQ ID NO: 554948 - DNA, 488 bp, Homo sapiens; identical to SEQ ID NO: 537260
  misc_feature: HIJSMM301CWERS.47.70.G04.1.454.light.4.raw

SEQ ID NO: 554949 - DNA, 495 bp, Homo sapiens
  misc_feature: HIJSMM301CDFQ7.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggaccaacttttagatgaggccgactatttctgtcacacgtgggacatgggcactgcgatcttcggcggagggaccaagctgaccgtcctgggtcagcccaacggctgccccctccggtcact

SEQ ID NO: 554950 - DNA, 445 bp, Homo sapiens
  misc_feature: HIJSMM301CRFUU.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactagtttgggtgtttgggtgttcggcggagggaccaagctgaccgtcctaagtcagccaaggctcgccccctcggtcactctgttcccgccctcctccgtgtctgat

SEQ ID NO: 554951 - DNA, 501 bp, Homo sapiens; identical to SEQ ID NO: 554623
  misc_feature: HIJSMM301BB4ID.22.15.B04.1.454.light.4.raw

SEQ ID NO: 554952 - DNA, 502 bp, Homo sapiens
  misc_feature: HIJSMM301BUKMQ.43.62.F07.1.454.light.4.raw
tgtgagtagtcacgaccggtgctcgatttagtagtcgcataaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactgtggctgcaccatctgtcttcatcttccccg

SEQ ID NO: 554953 - DNA, 483 bp, Homo sapiens
  misc_feature: HIJSMM301BBT2R.51.39.D06.1.454.light.4.raw
cgatcgtatacacgaccggtgctcgatttagtgacatctcgcagttctttgggggcctgagagagaataagagaggcctggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactattctgtcaatcttcagacgtcagtggtacttatgtcttac

SEQ ID NO: 554954 - DNA, 490 bp, Homo sapiens; identical to SEQ ID NO: 535420
  misc_feature: HIJSMM301DW37E.3.72.G06.1.454.light.4.raw

SEQ ID NO: 554955 - DNA, 500 bp, Homo sapiens
  misc_feature: HIJSMM301BONGX.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactgaaaatcagcagagtggaggctgaggatggttgggctctattatgtcatgcagactctacaacgtaccgcctctacttcggtcgggacgggacgaacggtaggaggagtacaaacgaacgta

SEQ ID NO: 554956 - DNA, 495 bp, Homo sapiens; identical to SEQ ID NO: 535486
  misc_feature: HIJSMM301D1EXK.26.72.G06.1.454.light.4.raw

SEQ ID NO: 554957 - DNA, 497 bp, Homo sapiens
  misc_feature: HIJSMM301EC6G9.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctccctcgagtgcgtct

SEQ ID NO: 554958 - DNA, 476 bp, Homo sapiens
  misc_feature: HIJSMM301CYFFX.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaagtttcagtggcagtgggtctgggacagatttcactctcaccatcagcagtctgcaacctgaagattctgcaacttattactgtcaacagagtaacagttaccctcccactttcggcggagggaccaaggtggagatcaacgaactgtggctgca

SEQ ID NO: 554959 - DNA, 493 bp, Homo sapiens
  misc_feature: HIJSMM301CLVJK.48.78.H01.1.454.light.4.raw
agtatacatacacgaccggtgctcgatttagtgtgagtagtttgggtttggggtgggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattatattgctgctcatatgcaggtggtactacttgggtgttcggcagagggaccaagctgaccgtcctaggtcagcccaaggctg

SEQ ID NO: 554960 - DNA, 452 bp, Homo sapiens
  misc_feature: HIJSMM301EFC8R.40.81.H04.1.454.light.4.raw
tctagcgactcacgaccggtgctcgatttagtagtgtagattcgcgggggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttatcgggccgtccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaccatctgtcttcatcttcccgccatctgaagtcgctaga

SEQ ID NO: 554961 - DNA, 486 bp, Homo sapiens; identical to SEQ ID NO: 535043
  misc_feature: HIJSMM301AOH0B.46.35.D02.1.454.light.4.raw

SEQ ID NO: 554962 - DNA, 507 bp, Homo sapiens
  misc_feature: HIJSMM301EJN72.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaactgaccgtcctaggtcagcccaaggctgccccctcc

SEQ ID NO: 554963 - DNA, 515 bp, Homo sapiens
  misc_feature: HIJSMM301AH7NF.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccagaaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgccctcctcg

SEQ ID NO: 554964 - DNA, 471 bp, Homo sapiens; identical to SEQ ID NO: 536321
  misc_feature: HIJSMM301D1YIN.15.8.A08.1.454.light.4.raw

SEQ ID NO: 554965 - DNA, 481 bp, Homo sapiens
  misc_feature: HIJSMM301AXULU.13.50.E06.1.454.light.4.raw
tcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctggggacagacttcactctcaccatcagcagcctgcagtctgaagattttgcagtctattactgtcagcagtatagttactggagaaccttcggccaggacacgactggagattaaaggaactgtggctgcacc

SEQ ID NO: 554966 - DNA, 477 bp, Homo sapiens
  misc_feature: HIJSMM301ASA7B.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgca

SEQ ID NO: 554967 - DNA, 469 bp, Homo sapiens
  misc_feature: HIJSMM301DDD5Z.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggctgggacagcagcactgcccgctatgtcttcggaactgggaccaaggtcaccgtcctaagtcag

SEQ ID NO: 554968 - DNA, 507 bp, Homo sapiens
  misc_feature: HIJSMM301DWS9T.43.78.H01.1.454.light.4.raw
tgtgagtagtcacgaccggtgctcgatttagtgtgagtagtttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 554969 - DNA, 454 bp, Homo sapiens; identical to SEQ ID NO: 536347
  misc_feature: HIJSMM301A787K.19.86.H09.1.454.light.4.raw

SEQ ID NO: 554970 - DNA, 498 bp, Homo sapiens
  misc_feature: HIJSMM301DQ24R.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggaggaccgagctgaccgtcctacgtcagcccaaggctccg

SEQ ID NO: 554971 - DNA, 530 bp, Homo sapiens
  misc_feature: HIJSMM301BM0F4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccgaggaccgaacggtaggaagtacgaaacgaacctagtaggcgtgcgaccaactctcgttcttcctattcttcccgtccctactctcgt

SEQ ID NO: 554972 - DNA, 495 bp, Homo sapiens
  misc_feature: HIJSMM301DOOZF.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccaggggccaagctggagatcagacgaactgtggctgcaccatctgtcttcatcttcccg

SEQ ID NO: 554973 - DNA, 520 bp, Homo sapiens; identical to SEQ ID NO: 535773
  misc_feature: HIJSMM301DUH0F.41.19.B08.1.454.light.4.raw

SEQ ID NO: 554974 - DNA, 486 bp, Homo sapiens
  misc_feature: HIJSMM301C3K8M.46.35.D02.1.454.light.4.raw
  modified_base (481)..(481): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgnaccat

SEQ ID NO: 554975 - DNA, 489 bp, Homo sapiens; identical to SEQ ID NO: 535139
  misc_feature: HIJSMM301ANE2G.14.55.E11.1.454.light.4.raw

SEQ ID NO: 554976 - DNA, 494 bp, Homo sapiens; identical to SEQ ID NO: 534994
  misc_feature: HIJSMM301CWSJY.27.78.H01.1.454.light.4.raw

SEQ ID NO: 554977 - DNA, 445 bp, Homo sapiens
  misc_feature: HIJSMM301DKB6A.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccaccctcctcgacacgcgag

SEQ ID NO: 554978 - DNA, 441 bp, Homo sapiens; identical to SEQ ID NO: 535074
  misc_feature: HIJSMM301AF7AZ.11.3.A03.1.454.light.4.raw

SEQ ID NO: 554979 - DNA, 494 bp, Homo sapiens; identical to SEQ ID NO: 534992
  misc_feature: HIJSMM301BAN43.9.1.A01.1.454.light.4.raw

SEQ ID NO: 554980 - DNA, 504 bp, Homo sapiens
  misc_feature: HIJSMM301B6965.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaaactgtggctgcaccatctgtcttcatcttccccg

SEQ ID NO: 554981 - DNA, 494 bp, Homo sapiens; identical to SEQ ID NO: 534994
  misc_feature: HIJSMM301A2318.27.78.H01.1.454.light.4.raw

SEQ ID NO: 554982 - DNA, 517 bp, Homo sapiens; identical to SEQ ID NO: 549510
  misc_feature: HIJSMM301BZVKB.48.29.C07.1.454.light.4.raw

SEQ ID NO: 554983 - DNA, 515 bp, Homo sapiens; identical to SEQ ID NO: 536247
  misc_feature: HIJSMM301A1O5K.14.19.B08.1.454.light.4.raw

SEQ ID NO: 554984 - DNA, 517 bp, Homo sapiens; identical to SEQ ID NO: 546084
  misc_feature: HIJSMM301BUJXN.47.53.E09.1.454.light.4.raw

SEQ ID NO: 554985 - DNA, 490 bp, Homo sapiens
  misc_feature: HIJSMM301C5WK7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcttggacgttcggccaaggaccgaaaggaggataatcagacgaaa

SEQ ID NO: 554986 - DNA, 485 bp, Homo sapiens; identical to SEQ ID NO: 539299
  misc_feature: HIJSMM301BUHQE.3.10.A10.1.454.light.4.raw

SEQ ID NO: 554987 - DNA, 506 bp, Homo sapiens
  misc_feature: HIJSMM301EN4NV.48.25.C03.1.454.light.4.raw
agtatacatacacgaccggtgctcgatttagtagtgtagatttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggtccaagggaccgaaggtaggaaagtacagacgaaactagtggctgcacc

SEQ ID NO: 554988 - DNA, 496 bp, Homo sapiens; identical to SEQ ID NO: 537925
  misc_feature: HIJSMM301DK9R3.22.14.B03.1.454.light.4.raw

SEQ ID NO: 554989 - DNA, 477 bp, Homo sapiens; identical to SEQ ID NO: 543928
  misc_feature: HIJSMM301D3L15.16.86.H09.1.454.light.4.raw

SEQ ID NO: 554990 - DNA, 498 bp, Homo sapiens
  misc_feature: HIJSMM301D6NBL.52.27.C05.1.454.light.4.raw
cgcagtacgacacgaccggtgctcgatttagacgcgatcgaagggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 554991 - DNA, 501 bp, Homo sapiens
  misc_feature: HIJSMM301CGPF0.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataattatgaggtcactaagcggccctcaggggtccctgatcgcttcgtctgcctccaaggctggcaacacggcctccctgaccgtctctgggctccaggctgaggatgaggctgattattattgcagctcatatgcaggcagttacaatgtggatattcggcggagggaccaaactgacgtcctaggtcagcccaaggctgcccctc

SEQ ID NO: 554992 - DNA, 484 bp, Homo sapiens
  misc_feature: HIJSMM301CYA4R.46.26.C04.1.454.light.4.raw
  modified_base (433)..(433): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctntacaagtcccgctcactttcggcggagggaccaaggtggagatcaaacgaa

SEQ ID NO: 554993 - DNA, 482 bp, Homo sapiens
  misc_feature: HIJSMM301BGPQN.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctggtc

SEQ ID NO: 554994 - DNA, 508 bp, Homo sapiens; identical to SEQ ID NO: 545298
  misc_feature: HIJSMM301AKL4D.8.42.D09.1.454.light.4.raw

SEQ ID NO: 554995 - DNA, 447 bp, Homo sapiens; identical to SEQ ID NO: 535201
  misc_feature: HIJSMM301CU7VI.18.9.A09.1.454.light.4.raw

SEQ ID NO: 554996 - DNA, 472 bp, Homo sapiens
  misc_feature: HIJSMM301EEG1W.49.8.A08.1.454.light.4.raw
agtcgagagacacgaccggtgctcgatttagcatactctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcacttcggtcggagggacgaacgtaggaggatcaaacgaaactagt

SEQ ID NO: 554997 - DNA, 488 bp, Homo sapiens; identical to SEQ ID NO: 537260
  misc_feature: HIJSMM301DJ8T4.47.70.G04.1.454.light.4.raw

SEQ ID NO: 554998 - DNA, 523 bp, Homo sapiens
  misc_feature: HIJSMM301AH6TH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacggaccgaacggtggaaggtcaaacgaacgtacgtggcgtgcaccatctgtcttctatcttcccgtcccactctgact

SEQ ID NO: 554999 - DNA, 484 bp, Homo sapiens; identical to SEQ ID NO: 537427
  misc_feature: HIJSMM301CJPA0.26.78.H01.1.454.light.4.raw

SEQ ID NO: 555000 - DNA, 467 bp, Homo sapiens; identical to SEQ ID NO: 537890
  misc_feature: HIJSMM301BOB5X.3.68.G02.1.454.light.4.raw

SEQ ID NO: 555001 - DNA, 513 bp, Homo sapiens; identical to SEQ ID NO: 543313
  misc_feature: HIJSMM301DS6OV.22.36.D03.1.454.light.4.raw

SEQ ID NO: 555002 - DNA, 486 bp, Homo sapiens; identical to SEQ ID NO: 535043
  misc_feature: HIJSMM301C38QV.46.35.D02.1.454.light.4.raw

SEQ ID NO: 555003 - DNA, 502 bp, Homo sapiens
  misc_feature: HIJSMM301DZ89T.18.11.A11.1.454.light.4.raw
tacgagtatgcacgaccggtgctcgatttagctacgactgcgagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 555004 - DNA, 503 bp, Homo sapiens
  misc_feature: HIJSMM301B2AA6.14.55.E11.1.454.light.4.raw
  modified_base (483)..(483): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctggggacagatttcactctcaccgtcagcagtctgcaacctgaagattttgcaacttactactgtcaacagagttacagtacccccctctacttacgttcggacgggacggaacgaggacgagactagacgaacagtggtgtcncgaccactctcgtcttctta

SEQ ID NO: 555005 - DNA, 485 bp, Homo sapiens; identical to SEQ ID NO: 535963
  misc_feature: HIJSMM301AN76N.15.28.C06.1.454.light.4.raw

SEQ ID NO: 555006 - DNA, 504 bp, Homo sapiens
  misc_feature: HIJSMM301A3RO1.11.10.A10.1.454.light.4.raw
cgagagataccacgaccggtgctcgatttagcgtcgatctcagggggaactgctcagttaggacccagacggaaccatggaagccccacgcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccgaacggtgggaagtacgaaacgaaaccgtgtggcgtgcaccatctgtcttcactcttcccg

SEQ ID NO: 555007 - DNA, 445 bp, Homo sapiens; identical to SEQ ID NO: 537719
  misc_feature: HIJSMM301AINYP.47.85.H08.1.454.light.4.raw

SEQ ID NO: 555008 - DNA, 521 bp, Homo sapiens
  misc_feature: HIJSMM301BYJAR.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgt

SEQ ID NO: 555009 - DNA, 492 bp, Homo sapiens
  misc_feature: HIJSMM301EPCWT.14.55.E11.1.454.light.4.raw
  modified_base (454)..(454): a, c, t, g, unknown or other
  modified_base (458)..(458): a, c, t, g, unknown or other
  modified_base (474)..(474): a, c, t, g, unknown or other
  modified_base (482)..(482): a, c, t, g, unknown or other
  modified_base (487)..(487): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggacgacgacggaganacanacgaactagtggcgtncgaccacntcgtnttcta

SEQ ID NO: 555010 - DNA, 499 bp, Homo sapiens; identical to SEQ ID NO: 538774
  misc_feature: HIJSMM301A0V1L.26.26.C04.1.454.light.4.raw

SEQ ID NO: 555011 - DNA, 447 bp, Homo sapiens; identical to SEQ ID NO: 535201
  misc_feature: HIJSMM301EHEJA.18.9.A09.1.454.light.4.raw

SEQ ID NO: 555012 - DNA, 479 bp, Homo sapiens
  misc_feature: HIJSMM301B60AB.48.35.D02.1.454.light.4.raw
agtatacatacacgaccggtgctcgatttagcacacgatagttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagccgggacccaggctatggatgaggctgactattactgtcaggcgtgggacatcagcagtgaggtggttttcggcggagggaccaagctgaccgtctaagtcagcccaac

SEQ ID NO: 555013 - DNA, 482 bp, Homo sapiens
  misc_feature: HIJSMM301AMH20.48.35.D02.1.454.light.4.raw
agtatacatacacgaccggtgctcgatttagcacacgatagttgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggccg

SEQ ID NO: 555014 - DNA, 514 bp, Homo sapiens
  misc_feature: HIJSMM301CM08Z.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtcccgtggacgttcggccaaggaccaggtggcaatcaaccgaactgtggctgcaccatctgtcttcatcttcccgcc

SEQ ID NO: 555015 - DNA, 485 bp, Homo sapiens; identical to SEQ ID NO: 535606
  misc_feature: HIJSMM301BRMYX.47.46.E02.1.454.light.4.raw

SEQ ID NO: 555016 - DNA, 492 bp, Homo sapiens
  misc_feature: HIJSMM301DBZ4O.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagataaagtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 555017 - DNA, 447 bp, Homo sapiens; identical to SEQ ID NO: 535201
  misc_feature: HIJSMM301CPJN4.18.9.A09.1.454.light.4.raw

SEQ ID NO: 555018 - DNA, 489 bp, Homo sapiens; identical to SEQ ID NO: 535139
  misc_feature: HIJSMM301EPTMC.14.55.E11.1.454.light.4.raw

SEQ ID NO: 555019 - DNA, 485 bp, Homo sapiens
  misc_feature: HIJSMM301C82OR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatacaacgaactgtggctgcaccat

SEQ ID NO: 555020 - DNA, 518 bp, Homo sapiens; identical to SEQ ID NO: 539372
  misc_feature: HIJSMM301CRAP4.7.86.H09.1.454.light.4.raw

SEQ ID NO: 555021 - DNA, 517 bp, Homo sapiens; identical to SEQ ID NO: 538903
  misc_feature: HIJSMM301DRUBU.41.25.C03.1.454.light.4.raw

SEQ ID NO: 555022 - DNA, 494 bp, Homo sapiens; identical to SEQ ID NO: 534992
  misc_feature: HIJSMM301C959F.9.1.A01.1.454.light.4.raw

SEQ ID NO: 555023 - DNA, 502 bp, Homo sapiens; identical to SEQ ID NO: 543936
  misc_feature: HIJSMM301A7Y0D.15.1.A01.1.454.light.4.raw

SEQ ID NO: 555024 - DNA, 517 bp, Homo sapiens
  misc_feature: HIJSMM301D5MQQ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaagggaccaaggtggcaatcaaccgaactgtggctgcaccatctgtcttcatcttccccg

SEQ ID NO: 555025 - DNA, 494 bp, Homo sapiens
  misc_feature: HIJSMM301CXO4V.4.27.C05.1.454.light.4.raw
agcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactc

SEQ ID NO: 555026 - DNA, 480 bp, Homo sapiens; identical to SEQ ID NO: 535975
  misc_feature: HIJSMM301BJZZ9.51.60.F05.1.454.light.4.raw

SEQ ID NO: 555027 - DNA, 494 bp, Homo sapiens; identical to SEQ ID NO: 535629
  misc_feature: HIJSMM301B72T1.4.27.C05.1.454.light.4.raw

SEQ ID NO: 555028 - DNA, 527 bp, Homo sapiens
  misc_feature: HIJSMM301B0XFZ.49.21.B10.1.454.light.4.raw
agtcgagagacacgaccggtgctcgatttagtgtcgtcgcaagggggggtcgtcaggaggcagcgctcgcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataatttttgtctcctggtaccaacaccacccagacaaagcccccagactcattatttatggtgtcggtgaccggccctcaggggtttcgaatcgcttctctggctccaagtccggctacacggcctccctgaccctctctgggctccaggccggacgaggctgattattactgcgcctcatatacaaacaacaacatttgggtgttcggcggagggaccaagctgaccgtcctaggtcagcccaaggctgccccctcggtcactctgttcccaccctcctctctctcgact

SEQ ID NO: 555029 - DNA, 503 bp, Homo sapiens
  misc_feature: HIJSMM301C73AN.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccatgtca

SEQ ID NO: 555030 - DNA, 444 bp, Homo sapiens; identical to SEQ ID NO: 535192
  misc_feature: HIJSMM301C9ZL4.5.9.A09.1.454.light.4.raw

SEQ ID NO: 555031 - DNA, 488 bp, Homo sapiens; identical to SEQ ID NO: 535081
  misc_feature: HIJSMM301CGMAT.26.23.C01.1.454.light.4.raw

SEQ ID NO: 555032 - DNA, 491 bp, Homo sapiens; identical to SEQ ID NO: 535294
  misc_feature: HIJSMM301BRERA.16.68.G02.1.454.light.4.raw

SEQ ID NO: 555033 - DNA, 447 bp, Homo sapiens; identical to SEQ ID NO: 535201
  misc_feature: HIJSMM301DZYU8.18.9.A09.1.454.light.4.raw

SEQ ID NO: 555034 - DNA, 498 bp, Homo sapiens
  misc_feature: HIJSMM301AJOMQ.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgactgtggctgcaccatctgtcttcat

SEQ ID NO: 555035 - DNA, 477 bp, Homo sapiens
  misc_feature: HIJSMM301CRCXM.51.76.G10.1.454.light.4.raw
cgatcgtatacacgaccggtgctcgatttagtcactcatacagggggaacgtgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgactggtgctgcacc

SEQ ID NO: 555036 - DNA, 495 bp, Homo sapiens; identical to SEQ ID NO: 535007
  misc_feature: HIJSMM301BD9CL.22.5.A05.1.454.light.4.raw

SEQ ID NO: 555037 - DNA, 493 bp, Homo sapiens
  misc_feature: HIJSMM301DE643.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggccaagctgaccgtcctgggtcagcccaaggctgccccctcggtcact

SEQ ID NO: 555038 - DNA, 493 bp, Homo sapiens; identical to SEQ ID NO: 535047
  misc_feature: HIJSMM301BIZPB.16.53.E09.1.454.light.4.raw

SEQ ID NO: 555039 - DNA, 530 bp, Homo sapiens
  misc_feature: HIJSMM301DSFOU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaggaccgaacggtaggaaggtacgaaacgaacgtacgtaggcgtgtcgaccgaactactcgtcttctacttcttcccgtcccactctcgt

SEQ ID NO: 555040 - DNA, 519 bp, Homo sapiens
  misc_feature: HIJSMM301CIIST.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctcg

SEQ ID NO: 555041 - DNA, 493 bp, Homo sapiens; identical to SEQ ID NO: 536246
  misc_feature: HIJSMM301BHUTQ.49.66.F11.1.454.light.4.raw

SEQ ID NO: 555042 - DNA, 492 bp, Homo sapiens; identical to SEQ ID NO: 543155
  misc_feature: HIJSMM301DI7V0.10.53.E09.1.454.light.4.raw

SEQ ID NO: 555043 - DNA, 478 bp, Homo sapiens
  misc_feature: HIJSMM301EWF1B.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgt

SEQ ID NO: 555044 - DNA, 485 bp, Homo sapiens
  misc_feature: HIJSMM301D6ACS.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaacgattttgcagtttattactgtcagcagtatcatgactggccgctcaccttcggccaagggacacgactggagattaaacgaactgtggctgcaccat

SEQ ID NO: 555045 - DNA, 492 bp, Homo sapiens
  misc_feature: HIJSMM301BVXNQ.13.39.D06.1.454.light.4.raw
tcacgtactacacgaccggtgctcgatttagtgacatctcgcagttctttggggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 555046 - DNA, 454 bp, Homo sapiens; identical to SEQ ID NO: 535005
  misc_feature: HIJSMM301DJRQR.19.86.H09.1.454.light.4.raw

SEQ ID NO: 555047 - DNA, 485 bp, Homo sapiens; identical to SEQ ID NO: 536799
  misc_feature: HIJSMM301DDDBB.19.71.G05.1.454.light.4.raw

SEQ ID NO: 555048 - DNA, 513 bp, Homo sapiens; identical to SEQ ID NO: 535719
  misc_feature: HIJSMM301CHAXI.17.33.C11.1.454.light.4.raw

SEQ ID NO: 555049 - DNA, 479 bp, Homo sapiens; identical to SEQ ID NO: 535118
  misc_feature: HIJSMM301C9096.13.59.F04.1.454.light.4.raw

SEQ ID NO: 555050 - DNA, 489 bp, Homo sapiens
  misc_feature: HIJSMM301CXHLR.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcaccatctgtcttca

SEQ ID NO: 555051 - DNA, 489 bp, Homo sapiens
  misc_feature: HIJSMM301DO2QZ.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttatactgtcaacaatattataataatccatttaatttcggcggagggaccaaggtggagatcaaacgaactgtggctgcaccatctgtcttcatctttccgcc

SEQ ID NO: 555052 - DNA, 485 bp, Homo sapiens; identical to SEQ ID NO: 535880
  misc_feature: HIJSMM301AGQK8.7.75.G09.1.454.light.4.raw

SEQ ID NO: 555053 - DNA, 416 bp, Homo sapiens; identical to SEQ ID NO: 545902
  misc_feature: HIJSMM301DXNRP.18.78.H01.1.454.light.4.raw

SEQ ID NO: 555054 - DNA, 498 bp, Homo sapiens
  misc_feature: HIJSMM301BKELX.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctggtca

SEQ ID NO: 555055 - DNA, 513 bp, Homo sapiens
  misc_feature: HIJSMM301ANLQ7.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 555056 - DNA, 484 bp, Homo sapiens; identical to SEQ ID NO: 536395
  misc_feature: HIJSMM301DGJYR.46.35.D02.1.454.light.4.raw

SEQ ID NO: 555057 - DNA, 487 bp, Homo sapiens
  misc_feature: HIJSMM301ET8E3.49.76.G10.1.454.light.4.raw
agtcgagagacacgaccggtgctcgatttagtcactcatacagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 555058 - DNA, 501 bp, Homo sapiens
  misc_feature: HIJSMM301A16GX.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccaaggtggaggatcaaacgaactgtggctgcaccatctgtcttcatcttccccg

SEQ ID NO: 555059 - DNA, 486 bp, Homo sapiens
  misc_feature: HIJSMM301C8ODE.4.57.F02.1.454.light.4.raw
agcactgtagcacgaccggtgctcgatttagctcgatatagttgggtttggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgt

SEQ ID NO: 555060 - DNA, 499 bp, Homo sapiens; identical to SEQ ID NO: 542463
  misc_feature: HIJSMM301AOYMT.26.26.C04.1.454.light.4.raw

SEQ ID NO: 555061 - DNA, 484 bp, Homo sapiens
  misc_feature: HIJSMM301A7D48.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctgcatagtaatggagacaactatttggattggtacctgcagaagccagggtagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 555062 - DNA, 493 bp, Homo sapiens
  misc_feature: HIJSMM301BA06S.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgagatttaggatttactactgtcagcagacttacagtgttccgtacacttttggccaggggaccaaactggagatgaaacgaactgtggctgcaccatctgtcttcatcttccccg

SEQ ID NO: 555063 - DNA, 493 bp, Homo sapiens
  misc_feature: HIJSMM301DLBD6.11.81.H04.1.454.light.4.raw
  modified_base (403)..(403): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctccgtacacttttggccaggggaccaagctagaaatcaaacgaactgtggctgcaccatctgtcttca

SEQ ID NO: 555064 - DNA, 521 bp, Homo sapiens; identical to SEQ ID NO: 539470
  misc_feature: HIJSMM301DQYKB.27.23.C01.1.454.light.4.raw

SEQ ID NO: 555065 - DNA, 488 bp, Homo sapiens
  misc_feature: HIJSMM301CLIH3.10.23.C01.1.454.light.4.raw
catagtagtgcacgaccggtgctcgatttagtacacgtgattagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgaggacgaggctgactattactgctcagcatgggacatcagcctcagtggttgggtgttcggcggaggggaccaagctgaccgtcctaggtcacg

SEQ ID NO: 555066 - DNA, 495 bp, Homo sapiens; identical to SEQ ID NO: 550605
  misc_feature: HIJSMM301AJ162.41.38.D05.1.454.light.4.raw

SEQ ID NO: 555067 - DNA, 501 bp, Homo sapiens
  misc_feature: HIJSMM301ANMXU.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaaactgtggctgcaccatctgtcttcatcttcccgccat

SEQ ID NO: 555068 - DNA, 496 bp, Homo sapiens
  misc_feature: HIJSMM301CPHBO.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttcctgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 555069 - DNA, 490 bp, Homo sapiens; identical to SEQ ID NO: 535936
  misc_feature: HIJSMM301BDVF1.16.68.G02.1.454.light.4.raw

SEQ ID NO: 555070 - DNA, 383 bp, Homo sapiens; identical to SEQ ID NO: 550682
  misc_feature: HIJSMM301A1XVY.48.87.H10.1.454.light.4.raw

SEQ ID NO: 555071 - DNA, 500 bp, Homo sapiens
  misc_feature: HIJSMM301CRCDU.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttcatcttcccgcc

SEQ ID NO: 555072 - DNA, 473 bp, Homo sapiens
  misc_feature: HIJSMM301DBSOV.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctgca

SEQ ID NO: 555073 - DNA, 504 bp, Homo sapiens
  misc_feature: HIJSMM301B4Q8Q.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaagctgccccctcggt

SEQ ID NO: 555074 - DNA, 504 bp, Homo sapiens; identical to SEQ ID NO: 535561
  misc_feature: HIJSMM301B20EL.4.57.F02.1.454.light.4.raw

SEQ ID NO: 555075 - DNA, 489 bp, Homo sapiens
  misc_feature: HIJSMM301EFAFM.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatacaaacgaactgtggctgcaccat

SEQ ID NO: 555076 - DNA, 447 bp, Homo sapiens; identical to SEQ ID NO: 535201
  misc_feature: HIJSMM301AHOA0.18.9.A09.1.454.light.4.raw

SEQ ID NO: 555077 - DNA, 495 bp, Homo sapiens
  misc_feature: HIJSMM301B21T5.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggacgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 555078 - DNA, 502 bp, Homo sapiens; identical to SEQ ID NO: 538706
  misc_feature: HIJSMM301DDACO.19.10.A10.1.454.light.4.raw

SEQ ID NO: 555079 - DNA, 509 bp, Homo sapiens; identical to SEQ ID NO: 539359
  misc_feature: HIJSMM301DEQWH.47.85.H08.1.454.light.4.raw

SEQ ID NO: 555080 - DNA, 447 bp, Homo sapiens; identical to SEQ ID NO: 535201
  misc_feature: HIJSMM301DDWGK.18.9.A09.1.454.light.4.raw

SEQ ID NO: 555081 - DNA, 493 bp, Homo sapiens; identical to SEQ ID NO: 544835
  misc_feature: HIJSMM301D98V9.43.29.C07.1.454.light.4.raw

SEQ ID NO: 555082 - DNA, 485 bp, Homo sapiens; identical to SEQ ID NO: 538956
  misc_feature: HIJSMM301AXOHM.40.69.G03.1.454.light.4.raw

SEQ ID NO: 555083 - DNA, 505 bp, Homo sapiens
  misc_feature: HIJSMM301APQSL.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttatagtgatcattgggtgttcggcggagggaccaagctgaccgtcctaggtcagcccaaggctgccccctcggtcactctgtt

SEQ ID NO: 555084 - DNA, 504 bp, Homo sapiens; identical to SEQ ID NO: 535561
  misc_feature: HIJSMM301BVIF4.4.57.F02.1.454.light.4.raw

SEQ ID NO: 555085 - DNA, 496 bp, Homo sapiens
  misc_feature: HIJSMM301EKXUF.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttatttggtcaccttcggccaagggacacgactggagattaaacgaactgtgg

SEQ ID NO: 555086 - DNA, 375 bp, Homo sapiens; identical to SEQ ID NO: 544804
  misc_feature: HIJSMM301BDKH7.40.9.A09.1.454.light.4.raw

SEQ ID NO: 555087 - DNA, 485 bp, Homo sapiens; identical to SEQ ID NO: 535606
  misc_feature: HIJSMM301EG1E8.47.46.E02.1.454.light.4.raw

SEQ ID NO: 555088 - DNA, 488 bp, Homo sapiens
  misc_feature: HIJSMM301AMYYX.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtgagatcaaacgaactgtggctgcaccatctgtt

SEQ ID NO: 555089 - DNA, 486 bp, Homo sapiens
  misc_feature: HIJSMM301B3ZOC.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccgaaggtggagatcaaacgaactgtggctgcacat

SEQ ID NO: 555090 - DNA, 488 bp, Homo sapiens; identical to SEQ ID NO: 535990
  misc_feature: HIJSMM301C0S9J.11.28.C06.1.454.light.4.raw

SEQ ID NO: 555091 - DNA, 484 bp, Homo sapiens
  misc_feature: HIJSMM301DHYFL.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcacatct

SEQ ID NO: 555092 - DNA, 501 bp, Homo sapiens
  misc_feature: HIJSMM301AK42V.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaaattaacgaactgtggctgcaccatctgtcttcatcttcccg

SEQ ID NO: 555093 - DNA, 506 bp, Homo sapiens
  misc_feature: HIJSMM301A5HTF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatacaaacgaaactagtggctgcaccatctgtcttcatcttccccg

SEQ ID NO: 555094 - DNA, 497 bp, Homo sapiens; identical to SEQ ID NO: 536371
  misc_feature: HIJSMM301EOB9Q.16.78.H01.1.454.light.4.raw

SEQ ID NO: 555095 - DNA, 504 bp, Homo sapiens
  misc_feature: HIJSMM301DDF3L.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcctgggaccaaggtggagatcaacgaactgtggctgcaccatctgtcttcat

SEQ ID NO: 555096 - DNA, 477 bp, Homo sapiens
  misc_feature: HIJSMM301A67ZS.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctccgctcactttcggcgggggaccgaaggtggagagtcaagcgaactgtggctgcacca

SEQ ID NO: 555097 - DNA, 495 bp, Homo sapiens; identical to SEQ ID NO: 538269
  misc_feature: HIJSMM301AL5IH.9.1.A01.1.454.light.4.raw

SEQ ID NO: 555098 - DNA, 459 bp, Homo sapiens
  misc_feature: HIJSMM301AH1U4.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacggtatgt

SEQ ID NO: 555099 - DNA, 495 bp, Homo sapiens
  misc_feature: HIJSMM301ADXS9.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttacggccaagggacacgactggagattaaaggaactagtggctgcacatctgtcttcatcttccccg

SEQ ID NO: 555100 - DNA, 502 bp, Homo sapiens
  misc_feature: HIJSMM301CYIP1.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaacgaactgtggctgcaccatct

SEQ ID NO: 555101 - DNA, 485 bp, Homo sapiens; identical to SEQ ID NO: 536630
  misc_feature: HIJSMM301ED6RI.13.56.F01.1.454.light.4.raw

SEQ ID NO: 555102 - DNA, 507 bp, Homo sapiens; identical to SEQ ID NO: 544788
  misc_feature: HIJSMM301BC8HW.16.46.E02.1.454.light.4.raw

SEQ ID NO: 555103 - DNA, 500 bp, Homo sapiens
  misc_feature: HIJSMM301A2RTO.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcagggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtca

SEQ ID NO: 555104 - DNA, 490 bp, Homo sapiens
  misc_feature: HIJSMM301ARFOW.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggagacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacg

SEQ ID NO: 555105 - DNA, 495 bp, Homo sapiens
  misc_feature: HIJSMM301AMZWZ.3.33.C11.1.454.light.4.raw
agacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtaactctgttcccaccctcctcgagtgcgtct

SEQ ID NO: 555106 - DNA, 511 bp, Homo sapiens
  misc_feature: HIJSMM301D1AN7.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcc

SEQ ID NO: 555107 - DNA, 508 bp, Homo sapiens; identical to SEQ ID NO: 541327
  misc_feature: HIJSMM301CAC3K.47.85.H08.1.454.light.4.raw

SEQ ID NO: 555108 - DNA, 511 bp, Homo sapiens
  misc_feature: HIJSMM301AHNDP.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtaggagtatcaaacgaactacgtggctgcaccactctgtt

SEQ ID NO: 555109 - DNA, 502 bp, Homo sapiens
  misc_feature: HIJSMM301C0W4E.48.30.C08.1.454.light.4.raw
  modified_base (485)..(485): a, c, t, g, unknown or other
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccgaaggacgacacgtggagattaaacgaactgtggctgcaccatntgtcttcatccttcccg

SEQ ID NO: 555110 - DNA, 446 bp, Homo sapiens
  misc_feature: HIJSMM301DGIBS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagcccaaggccaacccctctgtcactctgttcccgccctcctccatactcgta

SEQ ID NO: 555111 - DNA, 499 bp, Homo sapiens
  misc_feature: HIJSMM301A3H5Z.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 555112 - DNA, 492 bp, Homo sapiens; identical to SEQ ID NO: 535126
  misc_feature: HIJSMM301B9HDI.18.11.A11.1.454.light.4.raw

SEQ ID NO: 555113 - DNA, 507 bp, Homo sapiens
  misc_feature: HIJSMM301AJI5K.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctggtcagcccaaggctcgtccccg

SEQ ID NO: 555114 - DNA, 354 bp, Homo sapiens; identical to SEQ ID NO: 535026
  misc_feature: HIJSMM301DNSJA.19.22.B11.1.454.light.4.raw

SEQ ID NO: 555115 - DNA, 506 bp, Homo sapiens; identical to SEQ ID NO: 539303
  misc_feature: HIJSMM301AYDNQ.8.19.B08.1.454.light.4.raw

SEQ ID NO: 555116 - DNA, 492 bp, Homo sapiens
  misc_feature: HIJSMM301BAAV6.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcact

SEQ ID NO: 555117 - DNA, 481 bp, Homo sapiens
  misc_feature: HIJSMM301A1UB2.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaacgaactgtggctgcacca

SEQ ID NO: 555118 - DNA, 496 bp, Homo sapiens
  misc_feature: HIJSMM301BM8AC.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccactctgtcttcatt

SEQ ID NO: 555119 - DNA, 483 bp, Homo sapiens; identical to SEQ ID NO: 535480
  misc_feature: HIJSMM301DH7JF.46.26.C04.1.454.light.4.raw

SEQ ID NO: 555120 - DNA, 492 bp, Homo sapiens; identical to SEQ ID NO: 543155
  misc_feature: HIJSMM301EB1GJ.10.53.E09.1.454.light.4.raw

SEQ ID NO: 555121 - DNA, 483 bp, Homo sapiens
  misc_feature: HIJSMM301BEHF5.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcccaccaacgttcagcggcagtggatctgggacagagttcactctcaccatcagcagcctgcagcctgatgatcttggaacttattactgccaacaatataatagttattggacgttcggccgaggggaccaaggtcgaaatagagacgaactgtggctgcacat

SEQ ID NO: 555122 - DNA, 472 bp, Homo sapiens; identical to SEQ ID NO: 535898
  misc_feature: HIJSMM301EYIYQ.15.8.A08.1.454.light.4.raw

SEQ ID NO: 555123 - DNA, 505 bp, Homo sapiens
  misc_feature: HIJSMM301ALXPN.8.55.E11.1.454.light.4.raw
ctcgcgtgtccacgaccggtgctcgatttagcactcgcacgttggggtttggggagctctgcttcagctgtgagcgcagaaggcaggactcgggacaatcgtcatcatgacctgctcccctctcctcctcacccttctcattcactgcacagggtcctgggcccagcctgtgttgacgcaggcgccctcagtatctgcggccccgggacagagggtcaccatctcctgctccggaagcacctcaaatattggggacagtttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactgggggacaggccgactattactgcggagcatgggatagcagcctgaacactgtggtcttcggcggagggaccaagctgaccgtccttagtcagcccaagg

SEQ ID NO: 555124 - DNA, 520 bp, Homo sapiens
  misc_feature: HIJSMM301BJDM1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgccct

SEQ ID NO: 555125 - DNA, 471 bp, Homo sapiens
  misc_feature: HIJSMM301B98KF.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggaggggaccaaggtggagatcaaacgaactgt

SEQ ID NO: 555126 - DNA, 484 bp, Homo sapiens; identical to SEQ ID NO: 537878
  misc_feature: HIJSMM301B3PCA.17.34.D01.1.454.light.4.raw

SEQ ID NO: 555127 - DNA, 486 bp, Homo sapiens; identical to SEQ ID NO: 537127
  misc_feature: HIJSMM301DYD3Q.3.77.G11.1.454.light.4.raw

SEQ ID NO: 555128 - DNA, 492 bp, Homo sapiens; identical to SEQ ID NO: 535335
  misc_feature: HIJSMM301EYRJH.16.53.E09.1.454.light.4.raw

SEQ ID NO: 555129 - DNA, 506 bp, Homo sapiens; identical to SEQ ID NO: 534969
  misc_feature: HIJSMM301EV584.18.37.D04.1.454.light.4.raw

SEQ ID NO: 555130 - DNA, 493 bp, Homo sapiens
  misc_feature: HIJSMM301CZBJM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggtttattactgcatgcaagctctacaaactccttacacttttggccaggggaccaagctggagatcaaacgaactgtggt

SEQ ID NO: 555131 - DNA, 501 bp, Homo sapiens
  misc_feature: HIJSMM301CQNWN.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtctt

SEQ ID NO: 555132 - DNA, 484 bp, Homo sapiens; identical to SEQ ID NO: 535400
  misc_feature: HIJSMM301EJS84.46.26.C04.1.454.light.4.raw

SEQ ID NO: 555133 - DNA, 494 bp, Homo sapiens
  misc_feature: HIJSMM301DPL6Z.43.39.D06.1.454.light.4.raw
tgtgagtagtcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcacatctgtctt

SEQ ID NO: 555134 - DNA, 489 bp, Homo sapiens
  misc_feature: HIJSMM301E3CG6.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggggtttattactgcatgcaagttctacaaacttcctacacttttggtccaggggaccaagctggagatcaaacgaa

SEQ ID NO: 555135 - DNA, 509 bp, Homo sapiens
  misc_feature: HIJSMM301DVJAM.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagccaaggccaacccactgtcactctcg

SEQ ID NO: 555136 - DNA, 495 bp, Homo sapiens; identical to SEQ ID NO: 535964
  misc_feature: HIJSMM301B15PD.16.10.A10.1.454.light.4.raw

SEQ ID NO: 555137 - DNA, 506 bp, Homo sapiens
  misc_feature: HIJSMM301CURI8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaagtcaaacgaactagtggctgcaccatctgtcttcatcttccccg

SEQ ID NO: 555138 - DNA, 491 bp, Homo sapiens
  misc_feature: HIJSMM301C6WIK.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcgggagggaccaagctgaccgtccgtgggtcagcccaaggctcgccccctcggtcactctcgttcccgccccgt

SEQ ID NO: 555139 - DNA, 477 bp, Homo sapiens; identical to SEQ ID NO: 535122
  misc_feature: HIJSMM301DRTAT.26.72.G06.1.454.light.4.raw

SEQ ID NO: 555140 - DNA, 503 bp, Homo sapiens
  misc_feature: HIJSMM301AGK64.15.25.C03.1.454.light.4.raw
tctacgtagccacgaccggtgctcgatttagtagtgtagatttgggtttgggggatcgggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgtt

SEQ ID NO: 555141 - DNA, 509 bp, Homo sapiens; identical to SEQ ID NO: 535457
  misc_feature: HIJSMM301D10T7.17.33.C11.1.454.light.4.raw

SEQ ID NO: 555142 - DNA, 495 bp, Homo sapiens
  misc_feature: HIJSMM301A9KX5.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaaacaccttcggccaagggacacgactggagattaaaggaactgtggctgcaccatctgtcttcatcttccccg

SEQ ID NO: 555143 - DNA, 454 bp, Homo sapiens; identical to SEQ ID NO: 534964
  misc_feature: HIJSMM301A65I5.19.86.H09.1.454.light.4.raw

SEQ ID NO: 555144 - DNA, 500 bp, Homo sapiens
  misc_feature: HIJSMM301DCQ0I.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagtggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaagctgcccctc

SEQ ID NO: 555145 - DNA, 493 bp, Homo sapiens; identical to SEQ ID NO: 543205
  misc_feature: HIJSMM301C3G2T.51.6.A06.1.454.light.4.raw

SEQ ID NO: 555146 - DNA, 488 bp, Homo sapiens; identical to SEQ ID NO: 541868
  misc_feature: HIJSMM301B6NWH.14.55.E11.1.454.light.4.raw

SEQ ID NO: 555147 - DNA, 485 bp, Homo sapiens
  misc_feature: HIJSMM301CMBCZ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagattttgcaacttactactgtcaacagagttacggtacccgtacacttttggccaggggaccaaactggacatcaaacgaactgtgctgcaccatctgtt

SEQ ID NO: 555148 - DNA, 488 bp, Homo sapiens
  misc_feature: HIJSMM301C0IZC.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacactttggtccagggaccgaagctggagatcaaacgaaa

SEQ ID NO: 555149 - DNA, 468 bp, Homo sapiens
  misc_feature: HIJSMM301EFKZ5.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataccg

SEQ ID NO: 555150 - DNA, 484 bp, Homo sapiens
  misc_feature: HIJSMM301A1WAI.26.78.H01.1.454.light.4.raw
agactatactcacgaccggtgctcgatttagtgtgagtagtttgggtttggggcagagccctggggaggaactgctcagttaggacccagagggaaccatggaagccccacgctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaa

SEQ ID NO: 555151 - DNA, 506 bp, Homo sapiens
  misc_feature: HIJSMM301EXGMI.9.31.C09.1.454.light.4.raw
tgatacgtctcacgaccggtgctcgatttagacgtctcatcaaggaaggaagggggggtcgtcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctgccccctcggt

SEQ ID NO: 555152 - DNA, 492 bp, Homo sapiens; identical to SEQ ID NO: 537509
  misc_feature: HIJSMM301DKK5K.13.46.E02.1.454.light.4.raw

SEQ ID NO: 555153 - DNA, 514 bp, Homo sapiens; identical to SEQ ID NO: 541865
  misc_feature: HIJSMM301CKA8N.15.86.H09.1.454.light.4.raw

SEQ ID NO: 555154 - DNA, 483 bp, Homo sapiens
  misc_feature: HIJSMM301DKV7W.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaaatataatagttattggacgttcggccaggggaccaaggtcgaaatgagacgaactgtggctgcaccatctgtt

SEQ ID NO: 555155 - DNA, 491 bp, Homo sapiens
  misc_feature: HIJSMM301EEHLR.52.31.C09.1.454.light.4.raw
cgcagtacgacacgaccggtgctcgatttagacgtctcatcaaggaaggaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgtttttcaacagacagcagtggtaatcatagagtgttcggcggagggaccaggctgaccgtcctaggtcagcccaaggctccg

SEQ ID NO: 555156 - DNA, 507 bp, Homo sapiens
  misc_feature: HIJSMM301AO8QB.3.79.H02.1.454.light.4.raw
agacgcactccacgaccggtgctcgatttagtgtcacacgaagggaaagggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 555157 - DNA, 472 bp, Homo sapiens
  misc_feature: HIJSMM301EH4S6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcttccgagtgccacttttggcggggggaccaaggtggacatcaaacgaa

SEQ ID NO: 555158 - DNA, 484 bp, Homo sapiens; identical to SEQ ID NO: 535400
  misc_feature: HIJSMM301BVI6P.46.26.C04.1.454.light.4.raw

SEQ ID NO: 555159 - DNA, 445 bp, Homo sapiens
  misc_feature: HIJSMM301AS3HO.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgttttgggtgttcggcggagggaccaagctgaccgtcctaagtcagcccaaggctgccccctcggtcactctgttcccgccctcctccgtgtctgat

SEQ ID NO: 555160 - DNA, 494 bp, Homo sapiens; identical to SEQ ID NO: 534992
  misc_feature: HIJSMM301ADA2E.9.1.A01.1.454.light.4.raw

SEQ ID NO: 555161 - DNA, 492 bp, Homo sapiens
  misc_feature: HIJSMM301DECWP.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcatcttcccgcc

SEQ ID NO: 555162 - DNA, 466 bp, Homo sapiens
  misc_feature: HIJSMM301DDEGI.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgaatcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaa

SEQ ID NO: 555163 - DNA, 490 bp, Homo sapiens; identical to SEQ ID NO: 546772
  misc_feature: HIJSMM301EEOC2.19.57.F02.1.454.light.4.raw

SEQ ID NO: 555164 - DNA, 493 bp, Homo sapiens; identical to SEQ ID NO: 535745
  misc_feature: HIJSMM301BHVZN.47.78.H01.1.454.light.4.raw

SEQ ID NO: 555165 - DNA, 495 bp, Homo sapiens; identical to SEQ ID NO: 535821
  misc_feature: HIJSMM301BJRC4.3.31.C09.1.454.light.4.raw

SEQ ID NO: 555166 - DNA, 493 bp, Homo sapiens
  misc_feature: HIJSMM301D4FMM.4.75.G09.1.454.light.4.raw
agcactgtagcacgaccggtgctcgatttagtatagacatcagggggagctacaacaggcaggcaggggcagcaagatggtgttgcagacccaggtcttcatttctctgttgctctggatctctggtgcctacggggacatcgtgctgacccagtctccagactccctggctgtgtctctgggcgagagggccaccatcaactgcaagtccagccagagtgttttatacagctccaataataagaattatttaggttggtaccagcagaaaccagggcagcctcctaaactgctcatttactgggcatctacccgggaatccggggtccctgaccgattcactggcagcgggtctgggacagatttcactctcacgatcagcagcctgcaggctgaagatgtggcagtttattactgtcaacagtattataatagtccgatcaccttcggccaagggacacgactggagattaaacgaactgtggctgcacca

SEQ ID NO: 555167 - DNA, 486 bp, Homo sapiens; identical to SEQ ID NO: 535043
  misc_feature: HIJSMM301BAEN7.46.35.D02.1.454.light.4.raw

SEQ ID NO: 555168 - DNA, 513 bp, Homo sapiens; identical to SEQ ID NO: 539551
  misc_feature: HIJSMM301CXXL4.47.85.H08.1.454.light.4.raw

SEQ ID NO: 555169 - DNA, 484 bp, Homo sapiens; identical to SEQ ID NO: 535400
  misc_feature: HIJSMM301B2BGP.46.26.C04.1.454.light.4.raw

SEQ ID NO: 555170 - DNA, 492 bp, Homo sapiens
  misc_feature: HIJSMM301BP1LT.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaattcggttcagggaccgaagttgaacatcaatcgaactgtggctgcaccatctgtctt

SEQ ID NO: 555171 - DNA, 506 bp, Homo sapiens
  misc_feature: HIJSMM301C23EE.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgcccccg

SEQ ID NO: 555172 - DNA, 489 bp, Homo sapiens
  misc_feature: HIJSMM301EI8Z2.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaacccactgtcta

SEQ ID NO: 555173 - DNA, 503 bp, Homo sapiens; identical to SEQ ID NO: 536313
  misc_feature: HIJSMM301BRHTM.21.22.B11.1.454.light.4.raw

SEQ ID NO: 555174 - DNA, 502 bp, Homo sapiens; identical to SEQ ID NO: 545036
  misc_feature: HIJSMM301CAFP8.15.57.F02.1.454.light.4.raw

SEQ ID NO: 555175 - DNA, 497 bp, Homo sapiens
  misc_feature: HIJSMM301AEIPH.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctggtaccaacacgaccccaggccagcctccacgcacgctcatctatagcacaaacactcgctcttctggggtccctgatcgcttctctggctccatccttggaaacaaagctgccctcaccatcgacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 555176 - DNA, 503 bp, Homo sapiens
  misc_feature: HIJSMM301EGURA.41.21.B10.1.454.light.4.raw
tctatactatcacgaccggtgctcgatttagtgtcgtcgcaagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaaggtggaaattaaacgaactgtgctgcaccatctgtcttcatcttcccgccta

SEQ ID NO: 555177 - DNA, 512 bp, Homo sapiens
  misc_feature: HIJSMM301DYOM6.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtgttttcggcggaggcaccgaagtgaccgtcctcggtcagcccaaggctcgccccctcggtcact

SEQ ID NO: 555178 - DNA, 489 bp, Homo sapiens; identical to SEQ ID NO: 535139
  misc_feature: HIJSMM301CQHVQ.14.55.E11.1.454.light.4.raw

SEQ ID NO: 555179 - DNA, 484 bp, Homo sapiens; identical to SEQ ID NO: 537427
  misc_feature: HIJSMM301BT8OQ.26.78.H01.1.454.light.4.raw

SEQ ID NO: 555180 - DNA, 494 bp, Homo sapiens; identical to SEQ ID NO: 534992
  misc_feature: HIJSMM301CWZ2X.9.1.A01.1.454.light.4.raw

SEQ ID NO: 555181 - DNA, 511 bp, Homo sapiens
  misc_feature: HIJSMM301BVC03.9.43.D10.1.454.light.4.raw
  modified_base (492)..(492): a, c, t, g, unknown or other
tgatacgtctcacgaccggtgctcgatttagactagcagtaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggaggaccaagctgaccgtcctaggtcagcccaaggctcgccccctcggtcacncttgtcccacctcctcacg

SEQ ID NO: 555182 - DNA, 482 bp, Homo sapiens; identical to SEQ ID NO: 535216
  misc_feature: HIJSMM301CYPQG.17.26.C04.1.454.light.4.raw

SEQ ID NO: 555183 - DNA, 499 bp, Homo sapiens
  misc_feature: HIJSMM301DSJXF.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaatgatcaccttgccaaggacgacgactggagattaaaacg

SEQ ID NO: 555184 - DNA, 486 bp, Homo sapiens
  misc_feature: HIJSMM301DMVMP.46.35.D02.1.454.light.4.raw
actagcagtacacgaccggtgctcgatttagcacacgatagttgggtttgggggagctgctcagttaggacccagagggaaccatggaaaccccagcgcagcttctcttccacctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 555185 - DNA, 501 bp, Homo sapiens
  misc_feature: HIJSMM301BAQ8A.19.78.H01.1.454.light.4.raw
  modified_base (483)..(483): a, c, t, g, unknown or other
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttccccnccctcctccacgagagta

SEQ ID NO: 555186 - DNA, 483 bp, Homo sapiens
  misc_feature: HIJSMM301BQHTJ.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctggggctccaggctgaggacgagggctgattattattgcatctcatatacaaccaacagcactctcgactggtattcggcggagggaccaagctgaccgtcctaggtcagcccaaggctgcccccctcggtcactctgttcccaccctcctcgagtagtaca

SEQ ID NO: 555187 - DNA, 489 bp, Homo sapiens
  misc_feature: HIJSMM301EQ5MQ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgtttcggccaggggaccaaggtggaagtcaagcgaactgtggctgcaccatctgt

SEQ ID NO: 555188 - DNA, 444 bp, Homo sapiens; identical to SEQ ID NO: 535192
  misc_feature: HIJSMM301B12PQ.5.9.A09.1.454.light.4.raw

SEQ ID NO: 555189 - DNA, 510 bp, Homo sapiens; identical to SEQ ID NO: 546105
  misc_feature: HIJSMM301ASAAJ.9.37.D04.1.454.light.4.raw

SEQ ID NO: 555190 - DNA, 517 bp, Homo sapiens
  misc_feature: HIJSMM301CB2YI.13.37.D04.1.454.light.4.raw
tcacgtactacacgaccggtgctcgatttagtagcatactgttgggtttggggctggccctcagtaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtccagcccaaggctgccccctcggtcactctgttcccgcctcct

SEQ ID NO: 555191 - DNA, 480 bp, Homo sapiens; identical to SEQ ID NO: 535442
  misc_feature: HIJSMM301CXBGM.41.17.B06.1.454.light.4.raw

SEQ ID NO: 555192 - DNA, 497 bp, Homo sapiens; identical to SEQ ID NO: 535664
  misc_feature: HIJSMM301BVTIG.22.14.B03.1.454.light.4.raw

SEQ ID NO: 555193 - DNA, 485 bp, Homo sapiens
  misc_feature: HIJSMM301B34T7.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccgagggtggaaatacaaacgaactgtggctgcacc

SEQ ID NO: 555194 - DNA, 500 bp, Homo sapiens
  misc_feature: HIJSMM301DE44S.48.38.D05.1.454.light.4.raw
agtatacatacacgaccggtgctcgatttagtatctgatagttgggtttgggggggtcgacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgcccccc

SEQ ID NO: 555195 - DNA, 510 bp, Homo sapiens
  misc_feature: HIJSMM301ALKEN.41.19.B08.1.454.light.4.raw
tctatactatcacgaccggtgctcgatttagtgagtcagtaagggggcgtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattattactgcagctcatatacaagcagcagcactctcgtggtattcggcggagggaccaagctgaccgtctaggtcagcccaaggctgccccctggtcactctcg

SEQ ID NO: 555196 - DNA, 491 bp, Homo sapiens
  misc_feature: HIJSMM301DCR38.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggccaggggaccaagctggagatcaaacgaactgtgg

SEQ ID NO: 555197 - DNA, 447 bp, Homo sapiens; identical to SEQ ID NO: 535020
  misc_feature: HIJSMM301AE7HM.18.9.A09.1.454.light.4.raw

SEQ ID NO: 555198 - DNA, 460 bp, Homo sapiens; identical to SEQ ID NO: 536053
  misc_feature: HIJSMM301CIQAA.22.28.C06.1.454.light.4.raw

SEQ ID NO: 555199 - DNA, 486 bp, Homo sapiens; identical to SEQ ID NO: 535043
  misc_feature: HIJSMM301BFM9J.46.35.D02.1.454.light.4.raw

SEQ ID NO: 555200 - DNA, 505 bp, Homo sapiens
  misc_feature: HIJSMM301AWW7Y.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggaccccggggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatctacgtggtgcggtgttcggcggagggaccaagttgaccgtctgggtcagcccaaggctgccccctcggtcactctgttcccg

SEQ ID NO: 555201 - DNA, 522 bp, Homo sapiens
  misc_feature: HIJSMM301AS40B.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctcggtcactctgttcccgccctcctctctctcga

SEQ ID NO: 555202 - DNA, 492 bp, Homo sapiens
  misc_feature: HIJSMM301CLHXQ.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccagctagaatcaaacgaactgtggctgcaccatctgtcttcta

SEQ ID NO: 555203 - DNA, 501 bp, Homo sapiens; identical to SEQ ID NO: 539268
  misc_feature: HIJSMM301B3I1B.40.33.C11.1.454.light.4.raw

SEQ ID NO: 555204 - DNA, 485 bp, Homo sapiens; identical to SEQ ID NO: 536263
  misc_feature: HIJSMM301CYFCD.47.78.H01.1.454.light.4.raw

SEQ ID NO: 555205 - DNA, 494 bp, Homo sapiens; identical to SEQ ID NO: 534994
  misc_feature: HIJSMM301BF6HN.27.78.H01.1.454.light.4.raw

SEQ ID NO: 555206 - DNA, 473 bp, Homo sapiens; identical to SEQ ID NO: 546369
  misc_feature: HIJSMM301DY777.18.76.G10.1.454.light.4.raw

SEQ ID NO: 555207 - DNA, 490 bp, Homo sapiens; identical to SEQ ID NO: 536855
  misc_feature: HIJSMM301C7Q33.16.68.G02.1.454.light.4.raw

SEQ ID NO: 555208 - DNA, 480 bp, Homo sapiens
  misc_feature: HIJSMM301CH4S7.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcgggacc

SEQ ID NO: 555209 - DNA, 519 bp, Homo sapiens
  misc_feature: HIJSMM301AK767.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcggggcaaagctgccctgaccctaacgggggcgcagcctgaggacgaggccgactattactgcctactctactttggtggtgctgtgctattcggcggagggaccaagctgaccgtcttaagtcagcccaaggctgccccctcggtcactctgttcccaccctcctcctagtctacg

SEQ ID NO: 555210 - DNA, 495 bp, Homo sapiens
  misc_feature: HIJSMM301A3HX0.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactttcaacagcgtaccacaggattcactttcggccctgggaccagagtggatatcaaacgaactgtggctgcaccatctgtcttcatcttcccgt

SEQ ID NO: 555211 - DNA, 469 bp, Homo sapiens
  misc_feature: HIJSMM301CUN5R.18.59.F04.1.454.light.4.raw
tacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgta

SEQ ID NO: 555212 - DNA, 509 bp, Homo sapiens
  misc_feature: HIJSMM301AO3KP.22.65.F10.1.454.light.4.raw
  modified_base (429)..(429): a, c, t, g, unknown or other
  modified_base (486)..(486): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactcncctaccgtccgaacggaacgacacgtgaggaattaaacgtaaaccgtagtggcgtcncgaccaactctcgtcttcctact

SEQ ID NO: 555213 - DNA, 484 bp, Homo sapiens
  misc_feature: HIJSMM301DKFNG.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 555214 - DNA, 505 bp, Homo sapiens
  misc_feature: HIJSMM301BM230.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtcta

SEQ ID NO: 555215 - DNA, 520 bp, Homo sapiens
  misc_feature: HIJSMM301ADC6S.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactcttcg

SEQ ID NO: 555216 - DNA, 497 bp, Homo sapiens
  misc_feature: HIJSMM301AY1VV.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtgggttcaagactttcggcggagggaccgaaggtggaggatcaaacgaactgtggctgcaccatctgtcttcatt

SEQ ID NO: 555217 - DNA, 444 bp, Homo sapiens; identical to SEQ ID NO: 536484
  misc_feature: HIJSMM301BHB9E.8.11.A11.1.454.light.4.raw

SEQ ID NO: 555218 - DNA, 479 bp, Homo sapiens; identical to SEQ ID NO: 537141
  misc_feature: HIJSMM301A1T1A.7.76.G10.1.454.light.4.raw

SEQ ID NO: 555219 - DNA, 484 bp, Homo sapiens
  misc_feature: HIJSMM301DHS17.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 555220 - DNA, 499 bp, Homo sapiens
  misc_feature: HIJSMM301BPLDH.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaacgaactgtggctgcacatctgtcttcatcttccg

SEQ ID NO: 555221 - DNA, 447 bp, Homo sapiens; identical to SEQ ID NO: 541817
  misc_feature: HIJSMM301DOMLV.18.9.A09.1.454.light.4.raw

SEQ ID NO: 555222 - DNA, 504 bp, Homo sapiens; identical to SEQ ID NO: 536385
  misc_feature: HIJSMM301DI1WQ.27.78.H01.1.454.light.4.raw

SEQ ID NO: 555223 - DNA, 493 bp, Homo sapiens
  misc_feature: HIJSMM301B1U19.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgact

SEQ ID NO: 555224 - DNA, 493 bp, Homo sapiens
  misc_feature: HIJSMM301CK4C6.41.53.E09.1.454.light.4.raw
tctatactatcacgaccggtgctcgatttagagagagtgtgttgggtttgggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaaggctgaccgtcctaggtcagccc

SEQ ID NO: 555225 - DNA, 494 bp, Homo sapiens; identical to SEQ ID NO: 534994
  misc_feature: HIJSMM301C9IS5.27.78.H01.1.454.light.4.raw

SEQ ID NO: 555226 - DNA, 479 bp, Homo sapiens; identical to SEQ ID NO: 538204
  misc_feature: HIJSMM301AKOPV.51.60.F05.1.454.light.4.raw

SEQ ID NO: 555227 - DNA, 501 bp, Homo sapiens
  misc_feature: HIJSMM301D8YQA.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcat

SEQ ID NO: 555228 - DNA, 508 bp, Homo sapiens; identical to SEQ ID NO: 540739
  misc_feature: HIJSMM301ENFXO.14.7.A07.1.454.light.4.raw

SEQ ID NO: 555229 - DNA, 499 bp, Homo sapiens; identical to SEQ ID NO: 544841
  misc_feature: HIJSMM301DV2W8.19.10.A10.1.454.light.4.raw

SEQ ID NO: 555230 - DNA, 486 bp, Homo sapiens; identical to SEQ ID NO: 542999
  misc_feature: HIJSMM301AOOVH.17.55.E11.1.454.light.4.raw

SEQ ID NO: 555231 - DNA, 508 bp, Homo sapiens
  misc_feature: HIJSMM301ASGU2.47.59.F04.1.454.light.4.raw
agctcacgtacacgaccggtgctcgatttagtacacacacttagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtcctaagtcagcccaaggctgccccctcggtcactctgtt

SEQ ID NO: 555232 - DNA, 488 bp, Homo sapiens; identical to SEQ ID NO: 541987
  misc_feature: HIJSMM301D8LPR.8.12.B01.1.454.light.4.raw

SEQ ID NO: 555233 - DNA, 504 bp, Homo sapiens; identical to SEQ ID NO: 535077
  misc_feature: HIJSMM301AEO7P.8.28.C06.1.454.light.4.raw

SEQ ID NO: 555234 - DNA, 520 bp, Homo sapiens; identical to SEQ ID NO: 537173
  misc_feature: HIJSMM301DDMAM.27.23.C01.1.454.light.4.raw

SEQ ID NO: 555235 - DNA, 503 bp, Homo sapiens; identical to SEQ ID NO: 540136
  misc_feature: HIJSMM301C7Y9P.19.10.A10.1.454.light.4.raw

SEQ ID NO: 555236 - DNA, 484 bp, Homo sapiens
  misc_feature: HIJSMM301AFQ2N.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgagggttggttttcggcgggagggaccaagctgaccgtacctaagtcacgacccg

SEQ ID NO: 555237 - DNA, 483 bp, Homo sapiens
  misc_feature: HIJSMM301BO5VY.41.17.B06.1.454.light.4.raw
tctatactatcacgaccggtgctcgatttagtcgatagtgaagggggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggcccccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcaccatctgt

SEQ ID NO: 555238 - DNA, 481 bp, Homo sapiens; identical to SEQ ID NO: 539249
  misc_feature: HIJSMM301CQC3I.11.76.G10.1.454.light.4.raw

SEQ ID NO: 555239 - DNA, 491 bp, Homo sapiens; identical to SEQ ID NO: 535176
  misc_feature: HIJSMM301DC0WO.13.39.D06.1.454.light.4.raw

SEQ ID NO: 555240 - DNA, 507 bp, Homo sapiens; identical to SEQ ID NO: 535316
  misc_feature: HIJSMM301AFA8I.18.37.D04.1.454.light.4.raw

SEQ ID NO: 555241 - DNA, 499 bp, Homo sapiens
  misc_feature: HIJSMM301ARZCY.19.78.H01.1.454.light.4.raw
  modified_base (475)..(475): a, c, t, g, unknown or other
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctnttcccgccctcctccacgagagta

SEQ ID NO: 555242 - DNA, 502 bp, Homo sapiens; identical to SEQ ID NO: 549249
  misc_feature: HIJSMM301BP1X2.21.22.B11.1.454.light.4.raw
  modified_base (460)..(460): a, c, t, g, unknown or other

SEQ ID NO: 555243 - DNA, 491 bp, Homo sapiens; identical to SEQ ID NO: 538388
  misc_feature: HIJSMM301EHAVD.51.81.H04.1.454.light.4.raw

SEQ ID NO: 555244 - DNA, 523 bp, Homo sapiens
  misc_feature: HIJSMM301C9YVS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccgaccct

SEQ ID NO: 555245 - DNA, 501 bp, Homo sapiens
  misc_feature: HIJSMM301AYQTI.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgtaatcgcttctctggctccaagtctggcgacacggcctccctcgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 555246 - DNA, 454 bp, Homo sapiens; identical to SEQ ID NO: 536449
  misc_feature: HIJSMM301DS353.18.78.H01.1.454.light.4.raw

SEQ ID NO: 555247 - DNA, 514 bp, Homo sapiens; identical to SEQ ID NO: 550589
  misc_feature: HIJSMM301CV9IK.16.66.F11.1.454.light.4.raw

SEQ ID NO: 555248 - DNA, 488 bp, Homo sapiens; identical to SEQ ID NO: 542699
  misc_feature: HIJSMM301AZ7DH.12.51.E07.1.454.light.4.raw

SEQ ID NO: 555249 - DNA, 488 bp, Homo sapiens
  misc_feature: HIJSMM301CW648.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactacaaacgaa

SEQ ID NO: 555250 - DNA, 505 bp, Homo sapiens; identical to SEQ ID NO: 538422
  misc_feature: HIJSMM301CK6YZ.19.78.H01.1.454.light.4.raw

SEQ ID NO: 555251 - DNA, 492 bp, Homo sapiens; identical to SEQ ID NO: 535126
  misc_feature: HIJSMM301EPXH9.18.11.A11.1.454.light.4.raw

SEQ ID NO: 555252 - DNA, 440 bp, Homo sapiens; identical to SEQ ID NO: 543201
  misc_feature: HIJSMM301CRU7C.11.3.A03.1.454.light.4.raw

SEQ ID NO: 555253 - DNA, 497 bp, Homo sapiens; identical to SEQ ID NO: 539058
  misc_feature: HIJSMM301AP4QX.12.87.H10.1.454.light.4.raw

SEQ ID NO: 555254 - DNA, 507 bp, Homo sapiens; identical to SEQ ID NO: 535641
  misc_feature: HIJSMM301A72E1.10.88.H11.1.454.light.4.raw

SEQ ID NO: 555255 - DNA, 505 bp, Homo sapiens
  misc_feature: HIJSMM301DVTCT.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctagcaccatctgtcttcatcttccgcc

SEQ ID NO: 555256 - DNA, 493 bp, Homo sapiens; identical to SEQ ID NO: 541489
  misc_feature: HIJSMM301CNKPP.12.23.C01.1.454.light.4.raw

SEQ ID NO: 555257 - DNA, 375 bp, Homo sapiens; identical to SEQ ID NO: 537938
  misc_feature: HIJSMM301BOT8U.9.11.A11.1.454.light.4.raw

SEQ ID NO: 555258 - DNA, 477 bp, Homo sapiens
  misc_feature: HIJSMM301AG74Z.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccaaggacacgactggagattaaacgaactgtggctgcaccta

SEQ ID NO: 555259 - DNA, 500 bp, Homo sapiens
  misc_feature: HIJSMM301BI9VI.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccatgtca

SEQ ID NO: 555260 - DNA, 509 bp, Homo sapiens; identical to SEQ ID NO: 540303
  misc_feature: HIJSMM301C87WC.17.33.C11.1.454.light.4.raw

SEQ ID NO: 555261 - DNA, 495 bp, Homo sapiens
  misc_feature: HIJSMM301CXCVQ.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 555262 - DNA, 495 bp, Homo sapiens
  misc_feature: HIJSMM301D505D.19.71.G05.1.454.light.4.raw
tactctcgtgcacgaccggtgctcgatttagtgtcgtcgcaagagagagggggggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttcgtggacgttcggccaagggaccaaggtggatatcagacgaactgtgg

SEQ ID NO: 555263 - DNA, 497 bp, Homo sapiens
  misc_feature: HIJSMM301AYV34.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagaattaaaggaactggtggctgcaccatctgtcttcatcttccccg

SEQ ID NO: 555264 - DNA, 491 bp, Homo sapiens; identical to SEQ ID NO: 538238
  misc_feature: HIJSMM301BRLBY.26.78.H01.1.454.light.4.raw

SEQ ID NO: 555265 - DNA, 536 bp, Homo sapiens
  misc_feature: HIJSMM301B6E6G.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgacttctcaggctccctccttgggggcgaaagactgccctgacactgtctggtgtgcagcctgaggacgaggctgactattactgcctactctacttgtggtgctgtgctattcggcggaggggaccgaaagactgaccggtcttaatacaagcccaaaggacgtcgccccctcccggtccgtaactcctgttcccggtccctccctt

SEQ ID NO: 555266 - DNA, 480 bp, Homo sapiens
  misc_feature: HIJSMM301BCSD6.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtctcggtcagcccaaggctccg

SEQ ID NO: 555267 - DNA, 484 bp, Homo sapiens; identical to SEQ ID NO: 535240
  misc_feature: HIJSMM301DJDTB.47.60.F05.1.454.light.4.raw

SEQ ID NO: 555268 - DNA, 508 bp, Homo sapiens
  misc_feature: HIJSMM301DDAKT.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcact

SEQ ID NO: 555269 - DNA, 513 bp, Homo sapiens
  misc_feature: HIJSMM301ALWYF.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctcgccccctggtcactctgttccccg

SEQ ID NO: 555270 - DNA, 488 bp, Homo sapiens
  misc_feature: HIJSMM301CKQT5.17.34.D01.1.454.light.4.raw
cgtagactagcacgaccggtgctcgatttagatcgtctgtgttgggtttgggggtgatcaggacttctcagttcatcttctcacccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacacttgaaaatcagccgggtggaggctgaggacgttggaatttatactgtatgcaaggtatagagcttcctccgacgttcggccaaggaccaaggtggaactcaaacgaa

SEQ ID NO: 555271 - DNA, 498 bp, Homo sapiens
  misc_feature: HIJSMM301CS85B.18.11.A11.1.454.light.4.raw
tacgagtatgcacgaccggtgctcgatttagctacgactgcaggggcaggcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacaggatttcgactctcaccatcaccaacctgcaggctgaagatgtggcagtttattactgtcagcaatactatagtcctcctctcacgtttcggcggagggtaccaaggtggagatcaaacgaactgtggctgccaccatctgtcttcatcttcccgcat

SEQ ID NO: 555272 - DNA, 490 bp, Homo sapiens; identical to SEQ ID NO: 548461
  misc_feature: HIJSMM301B5EHQ.16.73.G07.1.454.light.4.raw

SEQ ID NO: 555273 - DNA, 501 bp, Homo sapiens
  misc_feature: HIJSMM301CXKUD.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgtcactttcggcggaggtgccactttcggcggagggaccaaaatagaggtcaaacgaactgtggctgcaccatctgtcttcat

SEQ ID NO: 555274 - DNA, 502 bp, Homo sapiens
  misc_feature: HIJSMM301D9LGR.48.87.H10.1.454.light.4.raw
agtatacatacacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatgtcaatcgaactgtggctgcaccatctgtcttcatt

SEQ ID NO: 555275 - DNA, 513 bp, Homo sapiens; identical to SEQ ID NO: 535244
  misc_feature: HIJSMM301EBEOC.17.33.C11.1.454.light.4.raw

SEQ ID NO: 555276 - DNA, 501 bp, Homo sapiens
  misc_feature: HIJSMM301CWPPU.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 555277 - DNA, 483 bp, Homo sapiens; identical to SEQ ID NO: 544786
  misc_feature: HIJSMM301EJYE7.46.26.C04.1.454.light.4.raw

SEQ ID NO: 555278 - DNA, 447 bp, Homo sapiens; identical to SEQ ID NO: 535020
  misc_feature: HIJSMM301EUX0N.18.9.A09.1.454.light.4.raw

SEQ ID NO: 555279 - DNA, 496 bp, Homo sapiens
  misc_feature: HIJSMM301A54ZH.4.3.A03.1.454.light.4.raw
agcactgtagcacgaccggtgctcgatttagagagcgtcacaggggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagagccaccctctcctgccgggccagtgagagtcttagcggcgactacttagcctggtaccagcaaaaacctggccagtctcccaggctcctcatctctggtgtatccttcagggccactggcatcccagacagattcaggggcagtgggtctgggacagacttcactctcaccatcagcagactggagcctgaagactttgcgctgtatttctgtcagcagtatgttttcgcacctttcactttcggcggagggaccaaggtggagaacaaacgaactgtggctgcaccatctgtcttcatt

SEQ ID NO: 555280 - DNA, 447 bp, Homo sapiens; identical to SEQ ID NO: 535201
  misc_feature: HIJSMM301EXH62.18.9.A09.1.454.light.4.raw

SEQ ID NO: 555281 - DNA, 488 bp, Homo sapiens; identical to SEQ ID NO: 535990
  misc_feature: HIJSMM301DLG6N.11.28.C06.1.454.light.4.raw

SEQ ID NO: 555282 - DNA, 485 bp, Homo sapiens; identical to SEQ ID NO: 538533
  misc_feature: HIJSMM301APGAV.47.78.H01.1.454.light.4.raw

SEQ ID NO: 555283 - DNA, 482 bp, Homo sapiens
  misc_feature: HIJSMM301DY4EI.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaacggtgggaaatacaaacgaaacctgtggctgca

SEQ ID NO: 555284 - DNA, 478 bp, Homo sapiens
  misc_feature: HIJSMM301DV733.3.33.C11.1.454.light.4.raw
agacgcactccacgaccggtgctcgatttagagtgagctcgttgggtttgggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaacagtataataccgcgtgacgttcggccaagggaccaaggtggagatcatacgaactgtggctgcacc

SEQ ID NO: 555285 - DNA, 491 bp, Homo sapiens
  misc_feature: HIJSMM301C3S2L.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaacgaactgtggctgcaccatctgtcttcatt

SEQ ID NO: 555286 - DNA, 512 bp, Homo sapiens; identical to SEQ ID NO: 542831
  misc_feature: HIJSMM301A44QO.43.19.B08.1.454.light.4.raw

SEQ ID NO: 555287 - DNA, 491 bp, Homo sapiens; identical to SEQ ID NO: 554635
  misc_feature: HIJSMM301CICBA.43.33.C11.1.454.light.4.raw

SEQ ID NO: 555288 - DNA, 444 bp, Homo sapiens; identical to SEQ ID NO: 535411
  misc_feature: HIJSMM301EC887.8.73.G07.1.454.light.4.raw

SEQ ID NO: 555289 - DNA, 509 bp, Homo sapiens; identical to SEQ ID NO: 543741
  misc_feature: HIJSMM301AGTN1.17.33.C11.1.454.light.4.raw

SEQ ID NO: 555290 - DNA, 495 bp, Homo sapiens
  misc_feature: HIJSMM301B91R6.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttcggtctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcctcagacgtatca

SEQ ID NO: 555291 - DNA, 504 bp, Homo sapiens
  misc_feature: HIJSMM301BWIJK.51.10.A10.1.454.light.4.raw
cgatcgtatacacgaccggtgctcgatttagcgtcgatctcaggggcagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaatggtccggtgttcggcggagggaccaaactgaccgtccttagtcagcccaaggctgccccccg

SEQ ID NO: 555292 - DNA, 485 bp, Homo sapiens; identical to SEQ ID NO: 536307
  misc_feature: HIJSMM301AIJHY.46.35.D02.1.454.light.4.raw

SEQ ID NO: 555293 - DNA, 491 bp, Homo sapiens
  misc_feature: HIJSMM301ATNXN.9.86.H09.1.454.light.4.raw
tgatacgtctcacgaccggtgctcgatttagtgctatagacttgggtttggggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaagcccccaaactcatgatttatgaagtcactaagcggccctcggggatttctgctcgcttctctggctccaagtccgtcaacacggcctcctgacaatctctgggctccagactgaggacgaggctcattattactgttgctcatatacaggtgtaagtagttgggtgttcggtcggagggaccaagctgaccgtcctaggtcagccaaggctgcccctcggtcactctgttcccaccctcctcagacgtatca

SEQ ID NO: 555294 - DNA, 488 bp, Homo sapiens; identical to SEQ ID NO: 538811
  misc_feature: HIJSMM301CL61B.40.83.H06.1.454.light.4.raw

SEQ ID NO: 555295 - DNA, 486 bp, Homo sapiens; identical to SEQ ID NO: 553923
  misc_feature: HIJSMM301CTY87.49.81.H04.1.454.light.4.raw

SEQ ID NO: 555296 - DNA, 504 bp, Homo sapiens; identical to SEQ ID NO: 551974
  misc_feature: HIJSMM301C2OFR.19.78.H01.1.454.light.4.raw

SEQ ID NO: 555297 - DNA, 507 bp, Homo sapiens
  misc_feature: HIJSMM301D4FID.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccca

SEQ ID NO: 555298 - DNA, 489 bp, Homo sapiens
  misc_feature: HIJSMM301AIDG6.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatactgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 555299 - DNA, 499 bp, Homo sapiens
  misc_feature: HIJSMM301AX8NK.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcaccc

SEQ ID NO: 555300 - DNA, 503 bp, Homo sapiens
  misc_feature: HIJSMM301CU5VZ.48.41.D08.1.454.light.4.raw
agtatacatacacgaccggtgctcgatttagtcacgcgagaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcgccggggaccaacgtggaaatcaaacgaactgtggctgcaccatctgt

SEQ ID NO: 555301 - DNA, 445 bp, Homo sapiens
  misc_feature: HIJSMM301A40CI.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctcgttcccaccctcctccgtgtctgat

SEQ ID NO: 555302 - DNA, 483 bp, Homo sapiens; identical to SEQ ID NO: 541990
  misc_feature: HIJSMM301AI26G.46.26.C04.1.454.light.4.raw

SEQ ID NO: 555303 - DNA, 504 bp, Homo sapiens
  misc_feature: HIJSMM301BX73U.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctccactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgaggggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactcgtcactcttcg

SEQ ID NO: 555304 - DNA, 441 bp, Homo sapiens; identical to SEQ ID NO: 551059
  misc_feature: HIJSMM301B0M24.11.3.A03.1.454.light.4.raw
  modified_base (423)..(423): a, c, t, g, unknown or other

SEQ ID NO: 555305 - DNA, 486 bp, Homo sapiens
  misc_feature: HIJSMM301DRZV8.41.10.A10.1.454.light.4.raw
  modified_base (422)..(422): a, c, t, g, unknown or other
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctnaaacgttcggccaagggaccaaggtggaaatcaaacgaactgtggctgcaccatctgtcttcat

SEQ ID NO: 555306 - DNA, 494 bp, Homo sapiens; identical to SEQ ID NO: 534992
  misc_feature: HIJSMM301BUB61.9.1.A01.1.454.light.4.raw

SEQ ID NO: 555307 - DNA, 454 bp, Homo sapiens; identical to SEQ ID NO: 536347
  misc_feature: HIJSMM301C59YZ.19.86.H09.1.454.light.4.raw

SEQ ID NO: 555308 - DNA, 505 bp, Homo sapiens; identical to SEQ ID NO: 535503
  misc_feature: HIJSMM301DWAK1.8.28.C06.1.454.light.4.raw

SEQ ID NO: 555309 - DNA, 484 bp, Homo sapiens
  misc_feature: HIJSMM301BLV3H.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggcctgggaccaaatggatatcaaacgaactgtggctgcaccatctgtt

SEQ ID NO: 555310 - DNA, 435 bp, Homo sapiens
  misc_feature: HIJSMM301CHPP7.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtactacttttggccaggggaccaagctggagatcaaacgaactgtggctgcaccatctgtcttcatcttcccgccatctgacatactcgta

SEQ ID NO: 555311 - DNA, 517 bp, Homo sapiens
  misc_feature: HIJSMM301A2C6Q.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaagctgccccctcggtcactctgttcccaccctcctcactactca

SEQ ID NO: 555312 - DNA, 511 bp, Homo sapiens
  misc_feature: HIJSMM301B5HRL.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtccactctgtt

SEQ ID NO: 555313 - DNA, 510 bp, Homo sapiens
  misc_feature: HIJSMM301BGSVM.51.35.D02.1.454.light.4.raw
cgatcgtatacacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcta

SEQ ID NO: 555314 - DNA, 488 bp, Homo sapiens
  misc_feature: HIJSMM301BKS4E.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggtccaggggaccaaggtcgaaatagagacgaactagtggctgcaccatctgtcttt

SEQ ID NO: 555315 - DNA, 517 bp, Homo sapiens
  misc_feature: HIJSMM301CMZBN.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtccactctgttcccgccctcctct

SEQ ID NO: 555316 - DNA, 473 bp, Homo sapiens; identical to SEQ ID NO: 535262
  misc_feature: HIJSMM301EOU9Y.8.67.G01.1.454.light.4.raw

SEQ ID NO: 555317 - DNA, 520 bp, Homo sapiens; identical to SEQ ID NO: 537173
  misc_feature: HIJSMM301DSS6W.27.23.C01.1.454.light.4.raw

SEQ ID NO: 555318 - DNA, 489 bp, Homo sapiens
  misc_feature: HIJSMM301BM1KJ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcacttctcaccatcagcagactggagcctgaagtattttgcagtctattactgtcagcagtatggtcacgtccaagtaactttggccgaggggaccaagctggagatacaaacgaactgtggctgcaccat

SEQ ID NO: 555319 - DNA, 515 bp, Homo sapiens
  misc_feature: HIJSMM301C12DZ.14.78.H01.1.454.light.4.raw
cgtctagtaccacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctcgtt

SEQ ID NO: 555320 - DNA, 490 bp, Homo sapiens
  misc_feature: HIJSMM301DZWB8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctacatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactagtggctgcaccatctcgtcttc

SEQ ID NO: 555321 - DNA, 487 bp, Homo sapiens
  misc_feature: HIJSMM301A4WP6.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtaggatatcagacgaa

SEQ ID NO: 555322 - DNA, 497 bp, Homo sapiens
  misc_feature: HIJSMM301C0U4W.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttctaaacgaactagtggctgcaccatctgtcttcatt

SEQ ID NO: 555323 - DNA, 488 bp, Homo sapiens; identical to SEQ ID NO: 542699
  misc_feature: HIJSMM301BNT5O.12.51.E07.1.454.light.4.raw

SEQ ID NO: 555324 - DNA, 478 bp, Homo sapiens
  misc_feature: HIJSMM301CMRBB.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaacgaactgtgg

SEQ ID NO: 555325 - DNA, 511 bp, Homo sapiens; identical to SEQ ID NO: 548439
  misc_feature: HIJSMM301BSTKH.16.46.E02.1.454.light.4.raw

SEQ ID NO: 555326 - DNA, 504 bp, Homo sapiens
  misc_feature: HIJSMM301AUE0S.3.70.G04.1.454.light.4.raw
agacgcactccacgaccggtgctcgatttagtgtagtgtgaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaaagtggatatcaaacgaactgtggctgcaccatctgtcttcatcttcccgccat

SEQ ID NO: 555327 - DNA, 490 bp, Homo sapiens; identical to SEQ ID NO: 551621
  misc_feature: HIJSMM301EG7RR.14.36.D03.1.454.light.4.raw

SEQ ID NO: 555328 - DNA, 491 bp, Homo sapiens
  misc_feature: HIJSMM301CY1JW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacacgtacccccctcactttcggcggagggaccaaggcggagatcagacgaactgtggctgcaccatctgtcttcta

SEQ ID NO: 555329 - DNA, 496 bp, Homo sapiens
  misc_feature: HIJSMM301DMA97.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcccaagggacacgactggagattaaacgaaactgtggctgcaccatctgtctt

SEQ ID NO: 555330 - DNA, 466 bp, Homo sapiens; identical to SEQ ID NO: 535366
  misc_feature: HIJSMM301EBC1A.13.4.A04.1.454.light.4.raw

SEQ ID NO: 555331 - DNA, 500 bp, Homo sapiens
  misc_feature: HIJSMM301DWTBY.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgttgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggctgccccctcc

SEQ ID NO: 555332 - DNA, 494 bp, Homo sapiens; identical to SEQ ID NO: 534992
  misc_feature: HIJSMM301EY20G.9.1.A01.1.454.light.4.raw

SEQ ID NO: 555333 - DNA, 508 bp, Homo sapiens
  misc_feature: HIJSMM301BMMWW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaagtacaaacgaactagtggctgcaccatctgtcttctatcttccccg

SEQ ID NO: 555334 - DNA, 499 bp, Homo sapiens
  misc_feature: HIJSMM301D6OCL.48.4.A04.1.454.light.4.raw
agtatacatacacgaccggtgctcgatttagagtagtgatcagggcacgaccggtgctcgatttagagtagtgatcaggggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtgggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgtaac

SEQ ID NO: 555335 - DNA, 508 bp, Homo sapiens
  misc_feature: HIJSMM301BMAWZ.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccaaggtggagatcaagcgaactgtggctgcaccatctgtcttcatcttcccgcca

SEQ ID NO: 555336 - DNA, 513 bp, Homo sapiens; identical to SEQ ID NO: 535719
  misc_feature: HIJSMM301AKXP2.17.33.C11.1.454.light.4.raw

SEQ ID NO: 555337 - DNA, 478 bp, Homo sapiens; identical to SEQ ID NO: 549111
  misc_feature: HIJSMM301DOVUM.16.86.H09.1.454.light.4.raw

SEQ ID NO: 555338 - DNA, 503 bp, Homo sapiens
  misc_feature: HIJSMM301DZ7EQ.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaacgtggaccaaggtctccgtcctacgtcagccaaggccaactccactgtcact

SEQ ID NO: 555339 - DNA, 485 bp, Homo sapiens; identical to SEQ ID NO: 539691
  misc_feature: HIJSMM301CVUNY.15.1.A01.1.454.light.4.raw
  modified_base (467)..(467): a, c, t, g, unknown or other

SEQ ID NO: 555340 - DNA, 489 bp, Homo sapiens; identical to SEQ ID NO: 544279
  misc_feature: HIJSMM301A3ZYZ.22.65.F10.1.454.light.4.raw

SEQ ID NO: 555341 - DNA, 494 bp, Homo sapiens; identical to SEQ ID NO: 534992
  misc_feature: HIJSMM301BUW68.9.1.A01.1.454.light.4.raw

SEQ ID NO: 555342 - DNA, 506 bp, Homo sapiens
  misc_feature: HIJSMM301EH8IL.48.21.B10.1.454.light.4.raw
agtatacatacacgaccggtgctcgatttagtgtcgtcgcaaggagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgcc

SEQ ID NO: 555343 - DNA, 490 bp, Homo sapiens
  misc_feature: HIJSMM301B6DKR.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaacgtaggacatcaagcgaactgtggctgcaccatct

SEQ ID NO: 555344 - DNA, 485 bp, Homo sapiens; identical to SEQ ID NO: 543370
  misc_feature: HIJSMM301DW0E5.3.10.A10.1.454.light.4.raw

SEQ ID NO: 555345 - DNA, 454 bp, Homo sapiens; identical to SEQ ID NO: 534964
  misc_feature: HIJSMM301BDUF7.19.86.H09.1.454.light.4.raw

SEQ ID NO: 555346 - DNA, 454 bp, Homo sapiens; identical to SEQ ID NO: 535005
  misc_feature: HIJSMM301DXMJU.19.86.H09.1.454.light.4.raw

SEQ ID NO: 555347 - DNA, 522 bp, Homo sapiens; identical to SEQ ID NO: 541090
  misc_feature: HIJSMM301D2DY8.27.23.C01.1.454.light.4.raw

SEQ ID NO: 555348 - DNA, 484 bp, Homo sapiens
  misc_feature: HIJSMM301DPURU.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttatactgccaacaatataatagttattggacgttcggccaggggaccaaggtcgaaaatgagacgaaactgtggctgcaccat

SEQ ID NO: 555349 - DNA, 504 bp, Homo sapiens
  misc_feature: HIJSMM301A9RDM.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcagtattatagtactcctccgacgttcggccaagggaccaaggtggagattaaacgaactgtggctgcaccatctgtcttcatcttcccgccatctgacatactcg

SEQ ID NO: 555350 - DNA, 485 bp, Homo sapiens; identical to SEQ ID NO: 535652
  misc_feature: HIJSMM301CVKX4.19.71.G05.1.454.light.4.raw

SEQ ID NO: 555351 - DNA, 504 bp, Homo sapiens
  misc_feature: HIJSMM301CDPL8.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgaatcaccttcggccaagggacacgactggagattaaacg

SEQ ID NO: 555352 - DNA, 507 bp, Homo sapiens; identical to SEQ ID NO: 538063
  misc_feature: HIJSMM301B9S4A.47.85.H08.1.454.light.4.raw

SEQ ID NO: 555353 - DNA, 480 bp, Homo sapiens
  misc_feature: HIJSMM301AZVVC.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacagattttactttcaccatcagcaggctgcagcctgaagatattgcaacatattactgtcaacagtatgatcgcctcccgctcactttcggcgggggaccgaaggtggaggatcaagcgaactgtggctgcaccatctgt

SEQ ID NO: 555354 - DNA, 486 bp, Homo sapiens
  misc_feature: HIJSMM301A9WY2.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaaactgaccgtcctaggtcagcccaaggctgccccccg

SEQ ID NO: 555355 - DNA, 461 bp, Homo sapiens
  misc_feature: HIJSMM301EDJLN.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctccctcacgcgtatgt

SEQ ID NO: 555356 - DNA, 497 bp, Homo sapiens; identical to SEQ ID NO: 538030
  misc_feature: HIJSMM301BJV5K.40.23.C01.1.454.light.4.raw

SEQ ID NO: 555357 - DNA, 414 bp, Homo sapiens
  misc_feature: HIJSMM301DXPQG.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccgccctcctccatactcgta

SEQ ID NO: 555358 - DNA, 444 bp, Homo sapiens; identical to SEQ ID NO: 535042
  misc_feature: HIJSMM301DMME3.10.76.G10.1.454.light.4.raw

SEQ ID NO: 555359 - DNA, 444 bp, Homo sapiens; identical to SEQ ID NO: 534993
  misc_feature: HIJSMM301D5ZXC.5.9.A09.1.454.light.4.raw

SEQ ID NO: 555360 - DNA, 496 bp, Homo sapiens
  misc_feature: HIJSMM301A68TY.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggagggaccaaggtggagatcaaacgaactgtggctgcaccatctgtctt

SEQ ID NO: 555361 - DNA, 479 bp, Homo sapiens
  misc_feature: HIJSMM301B7ZWW.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaacgaaactgtggctgcacc

SEQ ID NO: 555362 - DNA, 466 bp, Homo sapiens
  misc_feature: HIJSMM301BMQ4U.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttctaccatcagcagcctgcagcctgaagatattgcaacatattactgtcagcagtatgataatctcccgatcaccttcggccaaggacacgactggagattaaacgaa

SEQ ID NO: 555363 - DNA, 486 bp, Homo sapiens; identical to SEQ ID NO: 535385
  misc_feature: HIJSMM301CGTKO.19.71.G05.1.454.light.4.raw

SEQ ID NO: 555364 - DNA, 499 bp, Homo sapiens
  misc_feature: HIJSMM301CMSW1.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctgccccccg

SEQ ID NO: 555365 - DNA, 516 bp, Homo sapiens; identical to SEQ ID NO: 551269
  misc_feature: HIJSMM301DYYQQ.47.53.E09.1.454.light.4.raw

SEQ ID NO: 555366 - DNA, 508 bp, Homo sapiens
  misc_feature: HIJSMM301CYUHK.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtcctaggtcagcccaaggctgccccctcggtcactctgtt

SEQ ID NO: 555367 - DNA, 502 bp, Homo sapiens; identical to SEQ ID NO: 536253
  misc_feature: HIJSMM301A224M.21.22.B11.1.454.light.4.raw

SEQ ID NO: 555368 - DNA, 494 bp, Homo sapiens; identical to SEQ ID NO: 534992
  misc_feature: HIJSMM301CR5GM.9.1.A01.1.454.light.4.raw

SEQ ID NO: 555369 - DNA, 521 bp, Homo sapiens; identical to SEQ ID NO: 539470
  misc_feature: HIJSMM301DH32K.27.23.C01.1.454.light.4.raw

SEQ ID NO: 555370 - DNA, 478 bp, Homo sapiens
  misc_feature: HIJSMM301ADJIZ.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtggggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactagtggctgcaccat

SEQ ID NO: 555371 - DNA, 443 bp, Homo sapiens
  misc_feature: HIJSMM301C8GME.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctgccccctcggtcactctgttcccaccctcctctagagacacg

SEQ ID NO: 555372 - DNA, 505 bp, Homo sapiens
  misc_feature: HIJSMM301EUSM2.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaaactgtggctgcaccatctgtt

SEQ ID NO: 555373 - DNA, 518 bp, Homo sapiens
  misc_feature: HIJSMM301BLKO2.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggcaaggaccaaggtggacaatcaaccgaactgtggctgcaccatctgtcttcatcttccccg

SEQ ID NO: 555374 - DNA, 501 bp, Homo sapiens
  misc_feature: HIJSMM301BG7XL.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtcttaggtcagcccaaggctgccccctcggtcca
